United States Patent 12,642,819 (COMPOSITIONS AND METHODS FOR TREATING INFLAMMATORY BOWEL DISEASE) - sequence listing, part 46

SEQ ID NO: 16 - DNA, 6425694 bp, Bacteroides xylanisolvens (residues 1-2,141,898 of 6,425,694)
  modified_base (1037411)..(1037509): a, c, t, g, unknown or other
  modified_base (2129171)..(2129268): a, c, t, g, unknown or other
  modified_base (2347097)..(2347195): a, c, t, g, unknown or other
  modified_base (2808473)..(2808571): a, c, t, g, unknown or other
  modified_base (3469782)..(3469878): a, c, t, g, unknown or other
  modified_base (3594326)..(3594423): a, c, t, g, unknown or other
  modified_base (3916507)..(3916604): a, c, t, g, unknown or other
  modified_base (3943745)..(3943844): a, c, t, g, unknown or other
  modified_base (5698663)..(5698758): a, c, t, g, unknown or other
  modified_base (6326452)..(6327097): a, c, t, g, unknown or other
  modified_base (6376215)..(6376336): a, c, t, g, unknown or other
tttcttctcaatgttcctatttgggtaatcctgacggtttttcagattttatgtctgcacatccaagcatcaagcatgttttttgttctctatcgatggaggagggacgttacaatttttctatcatgaattattgtgaaaaccatttgctttattttcacggtgttcctaatgtatgtaaaggttttccgcgtcgtatctggcacagtatggttggcaatatgcctatcttgaatctgcgttatgaacctttgggtaagatggagaaccgtatgttgaaacggatgtttgatgttgttttctccggtttttttctggttacagtttttccctttgtttatctcatagtgggaagtattataaagttgacttctcccggtcctgtattctttaagcaaatgcgtacggggttgaatggtgtggattttgtgtgttataaattccgttctatgaaagtgaatgatgaagctgacagtaaacaggctacggctgatgatcctcgtaaaactcggtttgggaacttccttcgtcgttctaatattgacgaacttccccagtttatcaatgtttttaggggtgatatgtcaatagtgggaccacgtccacacatgttggctcatacggagacttatgcccgtttgattgataagtatatggtgcggcactttataaaacctggagtaaccggctgggctcaaacacatggttttcgtggtgaaacgagagaactctcacagatggaggaacgtgttaaagctgatatttggtatatggagcattggacaatgctacttgatatatatatcatttataagactatagcaaatgtagttgttggagaaaagaatgcatattaagataaggaatggattaaaattgagcagatacagatatcaatttctcaatgttgatataatatagctaatgaaatctttagctttaagaaagtgtattaacgaaggaaatattgtaattaattattagggaatgactaatcaatcagtacacttttagttatcttaagctgaaaaggttggatagttaaataatgtgcacttaatattatagaggactatgcgaagtttacatattatcatgccaatggcaggtgagggaacacgttttcttaaagaaggttggactacaccaaagccattgattgaattgaaggggatacctttgttcgttagagctattaggagcgtaattatggacgatataaatttgaagtattcatttattgttcgtcaggaacatattgatagatatcatataaacgaatatataaaaaacaagttgccaaatgctaaagttttttctgtacttaataccactcgtggtgcagttgaaacttgtttgatggctgagtctgcaatagaccctaatgattctgttatagttatggactgtgatttggaattctctagtaaggcttttcttgaaaatattcgtcaaatattagcaaaacctgtagatgaggtcaatggcggcttgttggtatcatttgaatcagaccttccaaagtatagttatgctgagattgatgctaataatatagtaaggcgtacagcagagaaagaggtaatatctaatcatgctctttgtggagcgtatttcttttcttcaggaaaaggttttttaaaagttgcgcatcaattattagataattcaatacctaataaatcggaattttatgtgtcattactttataattatttgttgaagaatggagaaactgtcaaactttgcttaatggaaaattattattcttatgggacacctgaagaacttaaacgatatatgtaatgctcggaagtgaaataaaactgttaattgtagattttgacggtacattagttgatacttttcgagctaattttatggcttatcaagaggcttttaatcaggtgggattagctcttaaagaggtagactatcgtcattgttttggttttaggtttgaaaagtttatggcaactgttggcataacagatccggttgtaactcaaaaaataagtgagtttaaaggtaattgttaccccgatttttttagatattttaaagtgaataattctttattagctatactgaaaacttttcacaatgctggaggtaaaacagcgatagcttctactgcatgtcgtaaaaatttagaaaaagcattgcaatacattgaggtaactgatatatttgatcttattttggcgggtgaggaggtgagacaaggaaaaccctcccctgagatatataggacagtattaaggcatttttctatgcaacctaatgaggcacttgtttttgaagattcggaagtgggtgtacaggcagcccagtcagcaggtataaactatatagttgttaattcaaactattatggagattgaaataagagggcattctggttgtcagatagacattgttaatggcggggatagcttgtttattaacaagagtactcgtgataagaattatattccacgattgtataagcaagctttgaaacagtgtaatgcttcaaagatagcttatcagcatattcgtgtaccgaaaatatatggtattgaacgtatggatgaatatctaaatattaagatggagtatatatatagtaagaattatgtagattattttgaagatgcaggatttgaccagattagttattttatcaaggcattgaaaatttttattgattctgaaattgaaaattcaaaaatgactccgattaataaaaatgttgtaataaataaatataatgatgtttgtgataaagttgctaaaaatgattttattagtaaggatacagatattaagataattctagagaagtcttcaattgtattcaatgaactagatgaagagataaacataccagttggacagtgtcatggagacttgactttttcaaatatactatttaatggaaataattactatttgatagactttctggactcatttttggaatctccattacttgatttagtaaagattaggcaagattcaaattatggttggtcgcagcttatgtatgggcatgattttgattctgtgcggatgagaataatttcagacaagatagataaagagatagatatatattatagtaattatgattggtataataagtattatagtacttttcagttgatgaatttcctacgtgttatacaatatgctaaggaggagagaactgtagcattcttaaaaaatgtcctcaattcaattttatgagtattagtttgattattcctataggagctgacaatattgagtatgagaactatatgccttatatatttaactttgctcctgatggaatctcgctttgcataaaatctattcaagggttagatttaaatcgttttgataatatctattttacaattcttgaaaaatatgataaaaaatactatttgtcattattgctgaaattgcaatttaaaaagttgggactgagtaatgctaaggtcgtagttcttgatgagccaaccactagccaggctgagactgtctatcggactgtgaattgcgagaacatagaaggagcaatttttgtgaaagatcctgatggctatttttgtggagattttaccattgcaaatagtatagctatttatccacttgataagttggaaatggtgaatccaagaaataagagttatgtggaacttgatgatcagttctatataacaaatataatagaaaaaaaaatcatcagccgtttctttaatgcaggaggttatatttttgatgatgctgctgtgttctgcaaatattatgagagattatatttgtatgaacaactttttatgtcgcatatagtctatgctatgctattggataatattccttttaggccttttgaggtgaaagacttccaagattggggaagtgaaagagattataattattatttactggatagattatggaagtattaaatggttttatagctggtcgatgtatcgtttataaaatatacaatcaatttgtattgataatttcttttattgatataataatagaaaatgatttcaagatcgaatatatgaatacaatccgtttttagtattctattgtgaagtatatttgataaaagtgatttttaacacacaaagccaataaatgttttttgggcgataacttatatgataaagaaggttagtatggctttctatgattaatgtataagaagggttaaggaaatagtggtctatgtaacttgtttataaagcaaatattttaatatttatgtcaagatcaataacagctaattatattttcaatctattgaatactatttctggaattctatttcctttaataacgtttccatattcatctaggattttgttagcagaaggaataggagaagtgaacttttatcaatcaataatatcatatatcagtttagttgtaggattaggtataccattatatgcagtaagagaaattgctagagtgagaaacgatagaaagcaacttaatgttaccacgattgagatattatctctacatggaattactaccttgattggttatttggtcgttgctattttatgttttacagttcccaagatacaaacagatttacctcttttcttgttgttaagttcttctatttttcttactaccattggatgtgaatggttttataaaggcattgaagattttaaatatattacggttcgtggtttgattgtccgtatgattgggattatattattgtttactttagtaaagacaaaaaatgatattctatggtatggtattacaattactcttacatcggtaggaaatagtgtattcaattttattagattacgtaaatatttgtgtatatgtaatattgatcgacgtagtattaatccttacaagcatttaaagtctgtaggtataacatttttattagttttattatctactatatatcttactcttaatccagtaattttaggatttatgactgatgatgtatatgttggttattattatggtggtataaaattgttttcactagtgtttggaatagtagattcgttaactgcaattttgctacctcggttttcgaatttgatggctgaaggaagagatgaagaatttgctacaatctctcaaaaagtatattcgtttactgttggagtttctttaccaatatctgttggactgttctttgttagtcaatatgctatacctattttgggtggtaatagttttataccatctataggtgtttctcagattttatctgttttgctggttttagtgggactttcaaatgtatttgggatgcagactctttatcctaaagggaaagtgtatattatggtgaaagtaactttaatggcatgtattacagacctcttagtgtgttttttgactattcctacattcaagcattatggtgctgctatggggtatttagctgcagaactagttgcaactacagggttgtacatcatgggaagaaagtatatttctattaggttattcgataaatcaataatacattatttattcgctgttattttaatggggggaggcttgtttgtgcttcagtcattaaattggaataatttattgatgtgcattataatgatgtgcgtaggagcttttatatatgtactttcacttttattgctaaaggattcgctgatattagaaggccttgcgattgttcaaaataaatgtttaaagaaataaaaatgcagttgattaagagtatattgcgaaagtttttttcatgtactatttcattgatgattcgtttatgtagaaatgaaaaggttatgctagatattttttctcgtagttttgaaaaatattcagataactatttttgttataaacttcgccccaaaaaagcagattattttattcctagtaatataaagactacaactacttctggtgaatttgctattgttcttcaagggttgatagagatgcgtgatgaatttacttttgagactattaaattatatagaagattgtttccgggagcaattatcatagttagtacttgggattatacagacccatctatagtacggactttggaattattagggtgcgaagttgttttgaataaagatatacctgtgtgtggcttggggaatgtaaactatcaaatttgcacaagcttggctggattgaaaagagctaaagaattgggagcagagtttgcattaaagaatagatcagatttacgtgtctatcgtgaatttgcttttgaatatcttaagagccttgttgaattaaatacgatttcttctagtaatgtttatggattgaaaggacgtataataacacaagctggtaattgggggcaaatgtttaatcctatgtggctgcaagattttctctattttggatatactgatgatcttataaacttatttgatattccatatgatgataggaatattcattgttatagaaaagataatttcgatacaaagcgagtactgacgggtgaaactcttgctaagtggccagcgtctgaaataaatataaccaaacgctttattcagaaatatcataattctgatttaagtctcaaagattggtggaattttctaggtgagtattgctatattgtagattcggaggacttattgacattgtggaataagtatggactcaatgacctgggacagttttactgtgaatacgatggtaagcacaattatagagatccatttcggcatataagttcatctgattttattaatatcatgaaccataagtatatatatgaagagtggatggaaaacgagaaggctaattacactatagaataatgaaaaatttaatagtttctgtagttcgtgttctagccattatacgacgatggacctttcactttacttagtaataagtgaccgatttatagtgttaagttttttatgctgtgaagaccaatcgctacagattcttattgggtatatgttggcctttaatttagttgctttgctgtatgtaattgggttataatatattagcaaaatatccttcagtaaaaggtcatttatggcatttaggatgtagtgaattcacaggatggtggtgtccgttatatgtagctgtagggactgtaattcctttaatttttgtgtacaagaagagttttgaaattaataataaataatatgaatatgaaatatattattgtcggagctggtatatcaggtttgagtattgggcaggttcttaaggagtatggacatgatgtgcaactatttgaggcagattcgcgtccaggagggatggtaaaatgtgatagagtgcatggacatttgtttcatcgcactggaggacatgtctttaacacaaaacgtcaggatgtattggattggttttggagtcattttgacaaaaaagacgagtttactatggcagatcgaaattcagttgtttcaatggctgataataccataattgcttatccaatagagaatcatgcttatcaactttcagatgagatgatgaaaaattttattaatgatattgtgttaatggctactaataagcctgtagaacctactaattttgaagaatttttgcgagctcgttttggtgagacactttatcgtgaatattttcgaccatacaatgaaaagatctggcgtcgtccactgacaaacgttccactgtcgtggttggttggtaaattaccaatgcctacacttgaagatattatttataataattttaagcatattgaggaaaggtcttttgtacatagttcgtttttttatccgaaaaaagagggttcgcagtttgtcgctaaccgcctttcagaaggacttgaaatacattataatgtagatgtaaaatctattgaaaaaatagaaaaaggatggtctgtgaacggagagatttgtgatagagttatttttactggcaatatgaagtcaatacctttaatagttaaaggagttgacttatcggcttatattgaaggtattgaagctcttgaagcccatggtaccacaactgtactttgtgagattgaagataatccatatagctggatttatatgccaagtcatattcatgaggcacaccgtatcatttgtacaggtaattttgcagagtcaaatcgtgcgaatggagtaatgtcggctaccattgagtttacagatgagattagtaagaatgatattattgataatctctctcgtataccatatcatcccaaatatatagcacataactatgctccttatacatatccaatccaagcaaaagatacacgtgaatttgtcaatagtgtgaaatgtgttactgagccagaaggtctatttcttcttggacgttttgctgaatgggagtattataatatggatgtagcaatgggggcagctctagatttgtgtaataataaattgaagtagtatgatagccgtaaatgtaaatgctggattggcaaatcaaatgtttcattatgcttttggtcgggggctgatggctaaggggttagatgtctgttttgatcaaagtaactttaaaccacgttctcaatgggcatttgaattggttagacttcaagatgcttttccctcgatagatataaaagtaatgccggaggggcattttaagtgggtatttccttctttaccgcgaaatggcttggagcgaagatttcaagagtttatgaagaaatggcataattttatcggtgatgaagtatacattgacgaacctatgtatggatatgtacctgacatggagaaatgtgctactagaaattgtatttataaggggttttggcaaagcgaaaagtattttagacattgtgaggatgatatacgtaaacagtttacttttttgccttttgatgaattaaaaaatattgaggttgcagcaaaaatgtcgcaggaaaattctgtagctattcacttacgtaaaggtgatgattatatgcaatcagaattgatgggaaaaggattatgtacagtcgattattatatgaaagcaattgattatatgagaaagcatataaataaccctcatttttatgtattcacggataatccttgctgggtaaaagataatcttcctgaatttgaatacatattagtagattggaatgaggtatcagggaaacgtaattttcgagatatgcagttgatgtcatgtgctaagcataatattataggaaatagtacttatagttggtgggcagcatggcttaatgcaaatcaggataagattgttgttgggcccaaaagatttttcaatccaatcaattcgtttttttcaacttgtgatataatgtgtgaagattggatttcattgtaaataagtgctagaatgtattaaataaatttgatgccatggtttgaactttctgttattttatcgttttttatgtaaaaatattttaagtgaaaactgttaaggaaatcattggaaaaataagaaatatgagtatgttgtcgaagatcgtattttcattatgtaatatttttcaatatttttttttattgccaggcaaagtatgtggtagattatttaattatgctatccattggcatttcaaggacattaaaggtcgtatatatcacgcgcgacagcttaaagggctacaatatgttaaaatagattatggtacaattctttctcgtggaatagtgcttacggcatgggataaatatgctggatacgattacactccttctattcagattggcagtcattgtagaattggggagtattgtcatattactgcttgtcatagtattacaataggtaataatgtgttaacaggtagatatgtctatatttctgataattctcatggtaaaaatatagagtcagaattaaatactcctccatcgttgcgaccactttatgcaaaaggtcctgttgtgatcggtaataatgtttggattggtgagagtgcacgtatactttcaggggtgactattggagatggggcaataatcggagctaatgctgtggtaactcatgatgttccaagtggagcagtagtagggggagtaccagctaaagtcattaaaatgatgacattgctagattgaaaagaatttgcaatataggtaaaaatattgctaactgtcaacaacgaagttgaaaaaatgatgataaaattaatatatgaatagaaaagcgcaagttattgcattttatttacctcaatttcatccattttcagaaaatgacgaatggtggggaaatggttttacagaatggacaaatgttggtaaagctaagcctttatttaaaggacatcggcaaccgcgagttcctgctgatttgggctattatgatttgagattatcagttgtacgagaacagcaggtaaaacttgcaaaagaagctggaatatttgggttttgttattggcattattggtttggaaatggaaagagacttatgcaagatgtatttgatgaagttcttgaatctggtaaacctgattttcctttttgtttagcatgggctaatcattcttggtattctaaaacatttgataaagattccacaggagataaattattaatggaacaaacatatccgggagaggaggatattgaaatgcatttttcttatttaaatcgtgcttttagggataaaagatatataaagatagatggaatgcctcttttagttgtttatgatccagtgtctttaccactgaagtatattgatatgtttcaacaattggctcgtgaggctgggtggttggatggcatttatatagtagctaatatagtaggtggcattaataaaaaagagatgtttattgaaaaaggatataatgctgtgacttttcagcgtttagctagtgtcatatttgatgctcaaaataaaagaggaaaaatattatattatatacgtcagaaaataagatctttgttttatcattatcctcaatttgctgttgattataaaaagtgcattccgtatttgataaataaaaatatagatgggagtgaagatgtgattccatgcattgtacctaattgggatcatactccacgaagtggaatgaaaggcagtatgtttttaaatgaatcccctgaattttttagattgcatgttgaagatgcccttaagacagttcaatataaaagaaataaattaatctttttgaaatcctggaatgaatggggagaaggtaattatatggaacctgatcttacatttgggaagggatatattaacgccttacatgaggcattgaatagtacattagggaaatgaaaaaagtggcttttgtttctgaaatggcattattggaaccaaatctaagtattgtgaagcgtttaaatacaacttatgatttgtattatgtcactgattgtcgacaggatattcctaataaatttggtataaagaatattagacgaggaatcaatagggctatagattatgaagaaatgacaaagttctcttcattttttaatcttcaaaaaacctacttgatttattctttgactaataaaaatttttttaacgcaataaagaaagcttatgatgtggtaagagttgtgagaaaaatatcacctagtgttatattaactgatacaacggctccctatactgtattgttgtttttgttttactatcataaaatagtattattagttcatgatccttttcctcattctggatataaaaaaaagtggcttatattgtttcgttatcttgcttttaaactgattcgtaataaagttatttttaatacgaagcaatatgaagcttttattagaaattataaactatctcctcaagatgtattttgttccaatttgagtacatttgaatttatgaaagtttatagaccgtgtaataagaaaaaagatggaaagttcaagattttattttgggggataatttctcaatataaaggtatagaatatctttgttccgcatttgaagaaatagtaaaacaaggctatcaagatatagagttaacgatagctggatcaggcgagttatatttcgatatagatccttatcttaagtatagcaattttaagtttatacacaaatttcttactaatgaggaaattgctgattatgtatttaatacagatatagtcgtttgtccgtatgtcgatgctacacaaagtggagtgattatgactgcttttgcatattgcaaacctgtaattgcgactaatgtaggaggactttctgaagttgttgatgagtattctggaattctaatagagccgcgaagcgtaaaacagcttgttgattcaattttgcttctgtataaaaaaccgtatataataaaacaaatggagagatatttgcgggaagattatgcggaaacggaaaaaggttgggaacatggaagtgcaattattgcttctgcaatagaaaagcagtatgaagaacaactttaatttggacataggcaaattaattctttatttggccatatttactcctttcatgcctaagttaaaactgggggaaattaatttatatttagttgaaatatttttattggtattttttcctttattgtttccttttattagacttaaatttcagagaatagttttggctatgtggggaatagtgttagtctcaactatttattcttttatttatgttattgaaatatcgtcattactgaaagttattaaaggaataatttatattcctcttggatatttggcttatgttgaatataaatgtaaccctagaattttgtgtaagattctttactcatattttttatgctcttttttaagtctatgtttatttttgtttcagctgtcagaatcggtttctatttggagtggcaatggtttcaattcaggtttgagtaataaatgttttgatttgaaatcaatgtctcttgtttcgtcaggtttatcagcccacggtgtctttggagattattcatgtcttatatttacatttgctttagtattgttcttctccaaaaaaattaaattatcaatgcttcttactacactgatgtttactgttataaatttgatgtcttctgttagtagagaagctttagtttgtttcatgtgtgtaatatgtggtctagtaattaagacaataagaaaaaagaaatattttgtagggtatattgtaattctaattattttaattagtgtggtgagtatttatggtgaatatattcctttagtaaataaaatattatatactcaagaggctataagtacaacaggaaatgaaggaaatattgaacttagaattggcgcttggaaattatttttttcttctttgatagataatcctttctttattttgactggatatggatacaattattctttttatgaagatattgtacggtcgatagcattaaaagtaaaatatccttttatattattgccagagaattattttgtacaatttttatggtatggaggagtgtttgctagcatttattcaattcttttttggaaagagatatttaaactttgtacaaatgtttttagaccatggagtttaatttctacaacttactttttaggacttttgataggtagtttaatttctgggtctgcaataacttcggatttattgtattgtcaagtattaattgttttgggaattatggctagtgaaaaacagaataataaaaacaatcaaatgaatttagagtaatgaatatattattgataacagttagagcagattttggaggaggtccgcgtcatgttcatcaattgattgaagagttaccttctgatttcaatatttatgtagctttccctcagggtaagccatatggcaatttgtggcaggagcatcctaaaataaagaaatgtataaatattccatataggaagttcagtattaaatacttattcttattaagacgctttattattgaaaacaatattagtatacttcattctcatggaaatggtgcaggtttatattcccgaattttgaaaataattgtgccgcagattaaagttgttcatacttttcatgggattacgaataattattcttcatattttatatcctgtatacataaaataataggacgtagtttaagatatcttacaaataaatttattttagtgtcaaatggcgagtttaaacttgggaaatcgatgcgttttttgtttacagataaatcagttataatatataatgctattgctgatgagggacttaaatttaatagatatgataataaacttgtaataatttcattatctcgctttgattttgcaaaaaatatggatatggcatatagaatagcaaaagcattaagaaataatcatgaaatagaatttgtgtgggtgggagatggagaagactttgtgcgattaaaacaaaaaagtgtagaagagcatgttaatataaattttattggattcacagaataccccatgtcttatcttaagaacgctgatttgtatctatccacttctcgttttgaaggtttaccatatgccctaattgaagctgcatcagtagggcttccaatagtcgctacagatgtggttggtaataatgaagttgtacttcacgattataatgggcttgtgtttaaaacagaacaagaagctgtagatgcaataaaaaaattatcgataaatgctgatttgttgaatcgatattcgataaattctcgtgaactttatcttaaaacttttacgatggaaaagatgatatcttctattgtagatacgtatgtacaggttttaaatcagtaagttattgtttaaaattgaaataagatgaagattgccatcattcaagaatggttagtaaccgttggcggttcagataaagtagtcaaagctattgcggatgtatttccagacgcagatatttacaccttagttgctaaaaaacaagtttgtgacgaattagggattgactggaataaagtccatacatcattcattcagaagttacctttaggggtaaagaagcataggatgtatttgcctatatttccgtttgcaatagaacagtttgatttacggggatatgatgtgattatatcatcttctcatgctgtagccaaaggagttctaaccaaagcggatcaattgcatatttgttattgtcattctcctattcgctatgtatgggatatgtatcatgaatacttggaagaatcagggttgacaaaaggcttgaaaggatatctggctaaatatatgcttcaccgtattcgtaaatgggatttgatatccagcttccgggttgactattttataagtaattcagattatgtgggacgtcgaattcaggagacatataggcgggatgctgtaacaattcaccctaatattgatatttctaactttgatttgtgcgtagagaaagaagatttctatttaactagtagtcgtttggtgggatataagaaaatagatcttattgtcgaagctttcagtcgtatgcctaataaaaagctggttgtgattggtggaggtcctaatttggaaaagatacgtaagattgccgggcataatgtaactgttatgggatatcagtcatttgccgtactaaaagaaaagatgcagaaagctaaagcctttgtttttgcagcagatgaggattttggtatgattccgattgaagcgcaatcatgtgggactcctgttattgcttatggcaggggaggttctttggaaacagtaaaagaaggagtaacaggtcttttcttttatgaacaaactgtagaatcggttattgatgcagtagaaagatttgaaaaactagaaacatcgtttgatcctaaaataatacgtaaccatgcggagactttttcggaagaacgttttaagaaggaaataaaggagtttgtagagttaaaatataatgaatttaatcatctattgaaatgagttattttatatttggcggttccggttttatcggtacgcaccttattgctctaattgataatttatatccgggtacaaaaatatacaatctggatattgtggagaataaccatgaaggtaaatctacatatatcaattgtgatgttcgttctgaaataaacattgatattcccgttacttccgaagacgtcatctttaactttgcagccgttcatcgtaccccggggcatccggaccaggcttattttgagacgaatattcgtggtgcagagaatgtatgcgcttttgccgagaagttcgggataaagaaaatcgtttttaccagttccatagctccttatggtgcagcagaagatttgaaaacagaagagacgcttcccacaccgaacacgccttatggaatttctaagttagtggctgaaaaaatacatacgatttggcaggcaaaaaagccgaacgaacgacaacttactattgttcgtccgggtgtggtattcggtaaaggggaaaatggtaactttacccgtttgtattggggtatccgtggcggtaagttcttctatccgggccgtaaagatacgattaaagcttgcatttatgtgaaagaattggttcgctttatgctttaccggttggagaatcatagtgaaggagtagagttatataactgtacatttgaatcggcttttactatcgagcaaatagtagaaacgatgaaaaaggctacgggactacaacgtaccattgtcaaggtgccgggaagtcttctaatgacagttgcaagtattgtcggtccgttagggggaaaagctttaggtatttgtcctgctcgtgtgaagaagttaatgatctctactaatatatgcggaaagaaactggctgattcggggtataagtttcattatacatttgaagaagctattaaggattggtatagagataatgatggtcagtgtttgagatgatttttcttaaacaatttgggtatatataataaatgttgaaaatgttgagatgtaataaacacgtgagtgtttcgtatgtgagatgaagaaaaatgtaggtccctagcttcatgctgtttacagcatgattctcctacattgtggattagaaatagcgcgacggcgcatttctaatctacgccctgacatcggaggttaaagccgatgtgaatttcccactatatcaactgtctgtgaagatcgttgatatttcctaattttacgtatagtgatgtatttagacacacaaatataaagaaaaaacattgggagatttgtatcgaaatatcccaatgtttgatttcaatcattgagatgtttttttcaaatcttccgatgtttttccgactctccaaaaggacaaaaggacaaaaaggacatatatgactgtttttattcatcttagtataagaatcatgaggtatattgctgatctttattatgttaaatgattttgtagacgtgttaccttacgaatgttgaaatcgtgttttgcgccaacctgaatcgttttgtctgtcatgaaatgcttggtcaactcttgaacgaaattacgtatattgtcaggattatttagtgaaaggaccgtgcttggaaagaagagcgatatcttgttcgcgtttgctttcgccttcaataatacaatcattcgacaataaggtaagattattgtacgaatttcggggaaataaaggagctcctttctggaattcctttcccaactaataggcttcgtcgttggcattggaatttttatagtaccataggggatttttgtccttatgtccttttgtccttttgaaaggagggcacgttggtgggggaaagaagaggtgcgtgagatttataacttgcttgtatccagtagataaactctcgtttcttttttagggacgaaaatttgtgtgctcgaaaaaatgcaggaagctcacgtaatatgcttttttgcgaatagtgttagtgacagttgattttagcagtggatcgctaattgtttccctatgtggacaatatttgataaagtaataaaaactgaaatattataaattattaatcatagaatgacatggcaaaagaaaaacagaaaccatacgagtttttaagcaatttggtattggctttaatgggaacggatcgtattttcagtaacagtttcttttccagcgaatttgctatctctcccaatacactgagtgagataagacggggagaggatatgtacatttatcagtatgtacgggtgatacggtgtatgatgaagtatcttcatttaattgttcgaatggatatgttgctgaaggaattaagaaccgtattagcttccaattgtgatttggtggttgctacgattccgcaccgttttcacggaacttaccaaccgaaagagtgggtggtagtaatgcattgggatggtataaaataaatgttgaaatgaagaaatatgtaggtccctagattcatgataaactcatgaaatccctacattttgcaggttagaaatcgtacagcggtatatttttaacttgaccctcgtatcggtgtaaaaactgatatgtatctatatgtgaaatataccaactgtctgtgaggatcgttggtatattgcgttttaagggaacgttgtaccataggggagtggaaaatagaatagatggttaaagaatacaaaaaaagagcaaactcataatgttcctaaatctttccggaatctgtatcgttatttgtagcatagaataaagtatagtattaacgctaaaagaataacgattatgaagaaaattctatctctacttgtactggctctggtagccgtgcagttttcattcgcaaaagatgtgataactaaagacatgaatcagttgccgcttccggcacgtaattttatcaatagtaattttacaaaaccacaggttgcccatatcaaaattgataaggatatgatggaatctaccaagtatgaagtggtattgatggatggtacggaaattgattttgacagtaagggaaactgggaagaggtaagtgctaagaaagggcagactgttcctgttagtattgttccgggattcgctgtcaactacctgaaagcacataattttgtgaatgaaggagtgacgaaagtggaacgtgaccgcaaagggtatgagattgaattgtctaccgggctttctttcaaatttgataagaaaggaaaatttatcaaggctgatgattaactagttgcagtaaatagacctaaacaagaagataactatgtggagatttaagtttagcgcatgggcagtagtgttgcttatgactgccctttctttcggcgcatgtgataatgacgatgatgatacttttgttccgcccagtaatattacggaggccttgaaacaggtatatccggctgctcagaatatagaatgggagatgaaaggtgcttattatgtagctgactgttgggtgagcaatgatgaattggaagtctggtttgatactaatgccaactgggtgatgacagaaaatgaactgaacagtattgatcagttggtgccggctgtttatacggcttttatggattctaaatataacgcgtgggtagtgacagatgtatatgtgttaacatttccacagaatccgatggaatctgtgattcaggtgaaacaaggtagccaacgctactcgctttatttcacgcaggatggcggattgatacatgagaaagatatcagtaatggagacgatacgaattggccgccaactgaataacttttaattataaaaaaacaacgggctatttctataaaaaagaatagcccgttgtttttttataattacatttgtttgtaatccttggccaatcctccttcacttgtttctttatagagtgacggtaggtcatgtccggtctgtttcatcacttgcactactttgtcgaaagagacacggtgcatgccatcggtgaaagctgaataaagattagcatccagcgcacgtgcggcggcgtatgcatttcgttcgatgcagggaatttgtaccaatccgcataccgggtcgcaagtcattcccaaatggtgttccaggcccatttctgctgcatactcaatttgtgcaggactgcccccgaacaattgattggcggcagccgaagccattgcgcaggcaacacctacttctccctgacaacctacttctgctccggaaatggatgcgttgaatttgacgatgttgccaaacaaaccggcagtggctaacgcacgtaaaatgcgcatatcgctaaagtcacggcttttttgaagatgataaagtacggcgggcatgactccgcaggagccacaggtaggagcggttactattttgccaccggaagcattttcttcacttacggctaaagcataagagaagacgagccctctggattgcagggattgtttgtatccggtagcacgtatgtaataagtggaagctttccgccggagatttagtggtccgggtagtacgccctctgcttcgagtccacggtgaatggcatctttcatggtagcccatacttcagccaggtagtcccatatatcttcttcctcacattcctttacgtattcccaataactttttccggtatcttcacaccattggagtatttcagtcatgttttccataccatatacatcggggctttcgatggttggattgtcattgttttctgccagtgcaccaccaccgatgctataaacagtccaattctcctgcactttatcgttgttatccagagctgcaaatgtcattccgttcggatggaacggtagaaagactttgggctgccacacaatttctaccggggcagtgggttgcaaagtgtctataatggctacatccgtcatgtgtcctttgcctgtagcagctaaactgccgtaaagggttactttaaaagatgcagcatccggatgacgttccagaaacatttcggcagctttgcgcggtcccatagtgtggctactggaaggtcctgtgcctattctatatagctcttttatcgatttcatgactgatgatgtgtttttgttaataccatttcttttttctgaagtacaaatatacaataataccgataattgccattacaatccaggcaaataaatacccgtattgccattcgagctcgggcatccatttgtaattcattccccatactccgaccagaaatgtcaaagggataaagatggtggatacgatggttaatctcttcatgatgtcgttcatacgtaaatcattgttggagatgtacagatcgactaatgaggaaagagtttcccggcagatctcaatggtctgtaatacaaattgcaagtggtcgtttacatcattgaaaaaggcacggttcactttgtgaatgagcaggttttctgcccgtagtaacttgatatattgttcttttagtggaaggatggattttttcatcagcatatattggcgtcgtaatgcctgaatctgaataccgatgtcatcaccgctggtgatggtgagcagttcttcttccaaatcttcgagtgcgtcatcaatggaagagattgttgaaatatagtttcccatgatgctgttgagcagcacgctaagtagataatcagtctggcggctgcgtatcttcaggacatcattgcgcagagcggaactgacatcatcgaagaagtcggtttctttttcgaggaaagtaagtacgtagttattacctagaataagacagacttgttgttggagcaactcgtccagttcgtcttcttctttatgttcgttggggtagaatatttttaagatcaggacgatgtatttgtcatgctcttctatcttggtaggatgatccgcattcagtatatcttgcaggactaggaagtctatttcaaaatgactgcaaatttcacggatagtctccgtatctttcattccgtgtatttgtagccaattgatccgatcgctgttcagtgttcccttgatggcttgaaaggtgtcgttggcgctttcctgcatctcggtagcattgtaagtacaaagatgtaagtgggtaggagtaagactgtctcctgtgtaaataagcttttcgcttaacagattattcttcatgctttattctcgttttagaaaaccactgtaacaaaggtagtggttttctaaatgagaacaagttctttggacgttttgtttacaggttagtcaaaatcgactactgtgattccggcaccgccaaactgcacatgttcgtcagcatagtggctcactcccggtacggtggccagatactggcggattaatgtacgaagtattcccgttcctgtgccgtgaaggatgcgtacacggtccatgccgactaatatggcgtcatcgataaaataggtgactgcttgcagagcttcgtctccgcgcattccacgcacatcgatgtcttgtttgaagctaagcttcttttcgtacatttggtcatgcgtctggctactgacaaaggtgcttttggcgattccttccgtcttgggtgcgttattggtacgttccaaacggtctatttttacggtcgtttttatgcttccaaaagcaacggttgcatttttaccattgatttccatcacttggccgacacttgtctgtcctttgatttttacattttcacctactgcaatcggtactactttaggagcacttgacggggaagagactgcggctttcggttcgtttttcttatttttcttccgttcttgtttctcctttaatttcttcattttctgtgcaatcttctcttcatgctctttagaagccagcgcatctaaagaagtacggaagtctgtcagttcctgacgtgcctggcgtgtcttttccttttcagcttgtgcttccttgattgtgcgtattgtgttttcaatgcgtgcattggattcctgaagcatccgttccgcttcttcttttgcttgccggatgatctctttccgtgatttctgcaactcttccatttccgtttggtagcgggcaatggtttcttccatgtgtttttcccgttgacggatagtttgacgttttccttcccagtaacgcttgtcgcgcacgatgtcctgaaggtatttgtcggcattgatatattcacttcctacgatttccgaagcatctgcaatgacatcttccggcaatccgatttttcgtgcgatttctacggcaaacgaacttccgggatttccgatttgtagctggaaaagtgcttgcatgagatggcggtcgtaaagcatggctccgttcactactccttcatgatcttcggcaaaatgtttcagattctggtagtgggtggtgatgactccgaatgttcctttctggttgaaacgtttcagaacggcttcggcaatagcacctccaatttgcggttccgtacctccaccgaattcgtcaatcaggatgaggctccgctcgttgcaactcttcatcatgattttcatattggtcaggtgagaagagtaggtactcaaatcgtcttcaatagattgttcatcaccaatatcgataaagatgctgctgaatataccggcgtgactgcgttcgtgcaagggaatgagcataccgcattgcaacatatattgcagtaaaccgactgttttgaggcagacggacttacctccggcattcggaccggatataataagaatgcgttgtttttgattcagttctatatccagtggtacgactttctttccgtgtttggcaagtgaaagttgtaataaaggatgcacagccattgtccagtccagtagttgctcattctctacagcgggtttcagactattggtctgtatggcgaaatagcttttcgcgcggataaaatctatttctgccagaaattcgtatgattgaaggatttccgggatagacggacggagaatgtttgaaaactcggtaaggatgcgaataatttcgcgtcgttcgtcgccttcgagttcgcgaatacggttgttggcttctacgacttccgccggttctataaacactgttttcccgctagcggattcatcgtgtacaatacctttgatttttcgtttgagtccgggtgcgacggggatcaccaaacgtccgtcacgcatggtgggagctacgtctttatctacgtatccttcggattgtgcgctgcgcagaatgctgtttaacgagcgggaaatatttcccatcgtactggcaagttcgcgacgtatacgggctaattcggtggaagcattatccttgatttttccatatttgttaaggatgccgtctatttttcctatcagttgagggaaaacggctatatctcctgccagtcgtttcagactggggtagggggtgtcgttctcttcttcatcttcattccgatggagaaaacgtacaatgtcgcggatggtttctaacgaacggcgcaggtcgaatagttcttgctcgtccagatacattccttctatccgcactcgctttagtgaagggcggacatcaaagaaaaattgatcgggaaatccgtctttttcctggatgatacggacaaactctgttacctggtttaatttctcctctacttcttcatgttgctcggaaaaggtcatgtctgtaactctttcttcgcctaaagtgctaagacacttatcttttagtaactgtctgatctggtcgaatcctatcttttgctcaaaattttgagggtatatcatatctttgttcttactaatggactgcaaaaatacgattaattcgcgaaaaaattatcagaatgtttgcagatttaaaaatgattcgtacctttgcaccgctttcaacggaaagcacttctgataaaggagttttggagaggtggcagagtggtcgattgcggcggtcttgaaaaccgttgtactgcgaggtacccggggttcgaatccctgtctctccgcaacaaacgctgaaaatcagcagattgcaaaacaaacacccagttttgcacccaagaatgtaaagtcgggtgtttttgttttatttaagataatacaaccactacataataaaagagtagcgatattaaaagaatccgatgagaaaagactaatatttatctatccattcactttgatttttcaggactttacatcgtcctgaaagtatttgttattgtattccaacgtcaggagtggattataatacaagttttttgtgtggatagaatttcgttttgcttaatgtacgaaagtacttatctataaacgcatgaaatattagcacaatgaatcattggaaatcaactttggccgtgataggaataggccaactcatatctattttaacaagtacgattgttggcttctccattattttttggattagcaacgaatttaaatccccgacagctttatctctggctattttagctggatttttaccacaatttgtattaggcttgtttgccggggtctatgttgacagatggaatcgaaagaaaacgatgttttattcggacttgttcatcgcgttctgtaccctatgtctttttattgtgataaccaagggttataaagacctttcttttttttatctattgactgcttgtcgttcaataggcagtacgtttcatgcacctgctttacaggcaagcatccctctactggttcccaagcaccatcttgtcagggtatcaggtttgtaccattccattcaatccttcagtgaggtgatagcccccgttgtaggggcaagcctcgttgtttggcttcccatacagtatattctgctcatagatgtgatcggagctgttgctgcttgtctgaccttactttgtgtccagattccttctcttcaaaaaacgaaagttcttccagatttcaaaaaagaactgacggaatgttggcataccttgcggcgtacaatgggcattttgcctttattcgtatgctttacgctggtgacttttgtccttatgcctgtttttacgttatttccttttatgacgcttctgcatttcaacggaaacattttgcaaatgggagttgtggaaatgggttggggctcaggggcattgttgggcggtttagtacttgcctgtaaggctttgaaaagcaagcaaacattagtgatgcatacggcttatgtgatattgggattgtatctgattagcgccagttatttaccatcaagcgcatttataggttttgtttgcctaacatttacaggaggcatagcctattccatttaccatgcgcttttcatcgctattattcagcagaacttggcttcggacatgcttggacggactttttctctcatctttagtttgagtacctttccatcaatgctgggtatcgtagcttcaggatattgggtggaagcatggggtatcacatccgtctttatgatcagcggatgggttatctttctgattggagtgggtgcaaattttatttcttcaatcaagcagttggataattacgcatagtattatttattaaagaattattatatgacaaagaaagaacacactacgattacagagttatttcaagttttggacttgttggaaagcctggacatgcagttttggttggatggaggctggggagtggatgtcttgtacggacagcaaacccgcttgcatagagatattgacattgattttgatgccaattatacagaccaactccttgatcttttgcaggagagaggatatcaaattgaaacaaattggttgcccacccgtgtggaactgtatagcaaagaattaggctatattgatatccatccttttgtcttgaatgcggacggcacttccaaacaagccgacttggatggaggctggtatgaatttcaaccggactattttggaacagcagtctttgaaggcagaagcatcccttgcatttctgcaaaagggcaacaagtattccattcgggctacgatttaagagagaaggatattcacgatttatctataattaaacaatgtataacaacaatgagcctaacaattagataagaacaagaaaatgacagaaaaacaaattgtctggtatatcttacttacagaagtaaagatagatagtgacacccagtctgtcacatccctgagtgtagctccattggcagtcttgccggaattccagcgtaagggaattgggggggatgttgattcagtaagcccatcagagggcagcacttttgggttacggcacagcagtcgtattggggcataaagagtattatcctcgatttggctatcgcaaggctatcgatttaggaattgaatttcctttcgaagtctctcatgaatattgcatggtggctgaattaatacctggagctactgagaatgtgaaaggtatggtttgttatccaactgactttaaatagtttaacaagtaaaattcattatataactcggactgggtatttcaatttcccagtccgtattctgatagtacttattcaattggaagattgtgttgcttcaagaatgaaagtttatcccaataccctctttgaaagacgattttgttatcttttacatgaaaaaatccgcatccacgaagtccaagagagtctttccattccatgatagcccattcgccatcttcaaaaatattttccaccatacaaaccattttagcagtggcaaattcattcacaaacattttgtagattgattctttaccaattattggttcgtttgcgacttgatgatttactgcattagtagcatacagctctgctatatgataagcatctgctttgttaaagcaatctatccatttttccaaaacttctttaggcttcattttttataaattcttaggattttgattctgtaataaaaacaatctgtttggatgcatagatacttgattttattaataataggctattctatattctaaatcctctggatttttgctctctctgcaccgagttacgtagattctgctgtaacttttcccattgttccttaaaccattgtactatgggttgtcggtttatggtcagcataagcttaccactatccatcggatgtttctcaaccctaaaaatatcattcttgatgtcaaatttccacctgtgttcttcggaataaattttgccactacattgtatggattctttctttgtcaagaggttttctatcatgtctttggtaaacccgataacagcgcataatttttccattctcaacatctctttgaacatgggaaaccatttgtgggctttttcaagcaaggtgctcaatcgtgatatttccttgtctttggcttcaagttcttgattatgtattctttgaagattacgaatttgtctgctatgctgttcctgtatttgttgtatctgaatttttaattcatcagtagctttgtcccgtttggtaatttcctgatgtagctgctcgatgtgatgttccagttctttcagcttaccgcttccgaaaagagaacctacaccgcttgctatggcggtagcagcattggtggctgttttctttagtttgtccgtgcgtatctctgcttttacctgtttgagttcctgttcggcaaggcttacttgttgttccttgtgtcgcttggtttcctctatacgttgcagttcggctttctgcttctcaatgatgaaatcatttcgttccagatgctctttacctgtgacagcttttgcctgtccacgttccatcaggagaatatcggaagcaagggtctgcatggttgccatatcctcgtcattgagctttcggctctttccagtttcatggttcatccagtcgaatacgacatgagcatgataatttggtttgaaccatctgttaccgacttggaagctctccttgtcttctgcttccggctgaccgttcagccaatgcccttcgtctttatgcaggaaaatctgtagcggagtgatgccccagcgtctttggcactcttcaccgaatttgcgtacatcagccagtgtggtgtccggtctgataagcaatactccttcacggatgggtgagcatcccgccaccttgataatctttccattctttcccttgcgttccctttccttttcctgcatggcacgtccggtcttttccttgaccatttgcttgatattgtcataatgagttcgcagttcgggagtgccgaagtcgggatttatccactgttcgttatcggtggaaagttcgggaacgacatagattctggactccccgatattacgcatatactcggcagtccttcgattgtgtgcctcgctcgatgcgatgttgcaaggcttgatatgtatgcttgattttgttgccatcttttcaatttttgattcggtaattactaattttgtttgctgctttccgctcataaccgcatggggttcttaggggtaacccataagcggagattgcaaagagagggtcactctttgctcggggttctcaggggtgaaacgccctgagtgggtcattagggcaaagccctaatcccctcgggagagcccacaactacgaaagcgaagcgtgtagttatagtgggctataaccggaagcctttcggtttcttggatagtgtatcattcctctttttgacagattgcgcttgctctttcctatcggctattcgtttctgtaaatattcgttcagatctttacatccactgtagatttgcgaggcgtcacgtatataccgggtagcatcatactcctttctgatttgctgtattgcttccattcctgcacggtcattgtcaaagaaacagtggatgcgctcatagcttcccaacggatagagtgccttgggaacattggctacggaattaagaactatgtaatcctgtctgtcgaagtcgggtgattgcggacagctttccagtcttaaggtcagaaaggaaaggtaatccataaatccctcaaaaacgtaacatgcactccttggctttcctgactgtctgatatgggatatttcttttggtgcgatacatcccttgaaatatcggttgcggatttcatatccacccgatatgttcggaaaagcaatggcgaaataacgtttgccgttgtgggtgaaacgggcttccttacattctcttttcgccagtgccgtgtttatccctctttcctgtagataggcaagcagggcaggagaagtcagctgtacaatgtccaactcctgaaaactcggttcggaaaatgactgcttgccaaaagagaaagatacgggacggatgtgcggagtctgttcctcgattttctgtagaagataaggtacatagtcggaatagtagagttcctgtgccagtgcaatgatatttccacctttaccaattgcaaaatcataccattggttgcgttcggtatttattttgaacgagggctctgtctcttcccgtaacggggatttataccacaggttgataccttgctgcttgacgggagaatgtcccaaactgtacagaaaatccgctatcctgatttgttttgctgtttgtatatccataataagatgagtgtttgaataatggttggaatatttatttctcttttcgcccgtacctttttatgaagtacggtctgtataatcacttcactttattttcgtatatataggatacggtaataaagtgaagcggttttacattctctgcaatcgcttcgctttatccttaatatatagacctgccgaataaagtgaagtgattacaggttagacggtctaatagtgaaagtctggcttgaacgtgtatttcctgccgttctcctgtactatcatccgtttgttccggagcatggtgataagtgataccgccttttgatggttcagttttacacctactgacatataagacttgattaaggcggtttccagatccttgtagccgtattcctctttcagtccgaaagccgcttctagtgctatgcggtgctgttgttcggtaatatgcctgtaagggtcgaacttttcctcttccggtcttccgggtttcttcgcttcgggtctgtacccctctatgagttcaggcaatgcattgtcgttgatacggaaagcgaaaggctcgaaatccattgcacgtatgtgcatggccgaaacattgcttatatccccgttgctcttgtccttttccacgagaagaacggtttccgccttgttgttcagctccgtaccgatatgccctcttgcgttttcatcgcctttgttctggtggagtatcgtatggatgtgtatttgcctgtcatccgtccactgcatcaacttggatatgatgcgtgtcgattctcccggactgttgatgtcatataccatatcacggatgccgtctatgattacaagccctatgtccggtgtattatagatagcctgttcgacaatcctgatgcgctgttcgggcgtgtatttcctcaaagcgagaaactccagatgttcattgtccctgtcatcaggaagaccggccagccgtaaaatacgtttcatgactttcaggcagtgataatggctttgttccgtgtccacataaaggactttccttttgttctccggaagttctgccacataccgtagtaccgtaccgtttttcaatgaggcggctacaatagccgacacattgaaagtctttttacttttggctttgcctatggatgcactgaaattgcccagtgtgccaatgaccgaaccttgcacttttaaaatctcaggtgctttctcatagattttcgataggctcagacgtgaggcttgccaaaggattatcgcctgttctgcagatatttcctttatttctctcatatagtccataagcatacctcccattatttccgtcctcctgttttctttccggcaagttcaagagccagttctgcatcaactataatcttgcgccctatctgggtaatcgccttgtctatcttaccgcttttctttatgcggttggcagtgggcagactgcacccgaacagtttggctataccgagtattccgtacacatacttcttttccgtgtctgtaacgggttgcggcaatgcttcggcctgacctgaagcgtgcttactcaggaatatgaattcttcgcctgtcatttgccagacgggttttgataataattcttggatatttgtcatcgtccaatctatttagtcgttaaacaatcagccctgcgcactggctgttatttctgttctcgaacgatgcaaaattaggtagggttatgagtggtaaggatggggacggtacaaactgaatatcattgtatcttattgaatatcagaaaacaaaaataccactcaaaaattattttgagtggtaaaagtggaactttcgtaaagtatcaggatatatcacggattatctgaatatatgttccatttccttggcgaaattttggttgctgtcactggggaaatctgaaacaggctccttgtacttggatttgtagtagctgtcgtcaatatccagcagtttcagtattctgtctttccatttgtccctgtcctgtttggagagtttctcgctcatcaggaatatcagatagcatacacgtattttctctctcggttttattttcagcttacagttgcaggggtgaagattcatattggcatagaaatctggtgcggaaatttcttcgaactgttctcctttgcacacctcatgaatgagcgaaagtaatttcatgctgaaatattcctgttgttcttctgtcgtttcctgctgactgattggctcgcttgatttattctcttgctttccgtcaggaatgtatttcttcaatatatccagaaaaaggcagctttgacggtatatgtccgcacaacagttcttcatatattggaatgcctctgttcttgtagccttttgctggtcatagagtttgttcagtttggctttttccctgtcatattcagccttgcagcgttcatattctttctctgcctgtttttcctcttcggctgtatgctccctgtaaccaatggaatcatacctgttgttggcttcattcagcggcttgctcagacttcttgtaacatccagctgggcttcaatttcctgagaatacctttccatgtgctgatagcaagcacgttctatggctctgtcacttaacgggcgtatctcataagcctgtatgctcttttctatttcagttttcagactgttgagtatcaaggtgtattgctctttttgcttgtcaagcaccagttcaaggatagcggcttcaaaggatttcatgtcattatactcctgatagaaatccgatatgaatttctgcctgtcaaaagaaaaagcgtaattatctatatagtctctgtatattctgttaagttctccatattggggaatcatcgtctgtatctttcctgccatatactttatattatgggttcttgtccttgtcaaggaataaggtcagttcttcttccacttcttctatactcggtagggcagatttcagattttcgggtactgccttgctcaattgatagtcgctgatacctatcggctggtcatatccagccaaggcatattgtgccacgacctcatccttacccctgcacagcaaaagaccgatggtcttgttatcattttctcccctcagtttatcatctacaacattgatatagaaatttaactgccctgcatattccggtttgaatggcgttgctttcaattccacgacgacataggcgtggagcttgatattatatagaatcaggtcggcgaaaaagtcactgtccccaatctggaaatgtttttgtctggcaacaaaagcaaagccgttacccatttccagcaagtaatgggttacatgctttaccaactgttcttctatatccctttcgtcagccttttcctttgctcctgccaagtcaaagatatacgggtcttttaacagataattggcaagatcgctttgaggtgccggaagtgtggcagtgaagttgtttaccttgttactcttgatttgtctgtcatacagattactttcaatctgcattttcagcacattactgctccaacccatttctacagattgtttcatataccaataccttacacctaatggtagcggattattgagtatgaccatatggcttgcccaatttattcttgcaatcggtgacgccaagaataaatcttctatatcctctatttttattttatagatggttgctactgttttttctacattctgaaattgcgcaggaacctcctgcgtaatttctaaagattgattatcagctgattgtatttgcgcagtaagctcctgcgtaaattgcccgctgttgagtttaaggacttcattagtaatgttttgaatattagggactgacagtattgaatctgtttcaataaaactacgaagtacatttaacggatataaacgggcaaactggcacatataagtaagattacgctccgaatatcccttcttttcaggataattgaatctgattgcctgtgccaacttcttgataattttaccaccccagccatgcaggttttggtggtacagtatataattgcccattttccagtaatggaacaacatctgggcattggctgcggtaatgagccggacttgtgcctgttctatttccgaaccgacagcatggacaaaggcatcaaaatgacctttctttatattatgttcgttgttattttccatattactaactattacttaacaaagataactctaataatggataatctgtgaaacagactgatacttttatagttggttaaacttgttcattgcattagccttaatatcatcggctatgtcaatgtagggcttcatggctttataatcactgtgtcctgtccatttcattacaacctgtgccggaatacctagagccagcgcattacagatgaatgttcttcttcctgcatgagtactgagcaatgcgtatttcggggtaacttcatctatgcgctcattccctttatagtaggtttcacgtatagattcgttaatttctgccagttctcccagttctttcagataatcattcattttctgattgctgataacaggcaataccatgtggttttcaaaatggatgtccttgtatttttcaagtatggctttactgtacttgttcagttcaatactcagactatctgccgttttaacggtggtgacttctatatggtcggacttgacatcacttctctttaggttgcgaacatctgaataacgcagactggtaaagcaacagaacaggaaaacatcccggacacgttccagatactgtttgtctttgggtatctgatagtctttaagtctgttcagttcttcccatgtcaggaagattaccttcttgggggtggttttcaatttcggtttgaacgtatcgtatgctatattctggtgatagtctttcttgaagctccaccgcaggaaccatttgaggaatcccatttgtttaccgatggtactgttcctcatatcctttttgtcgcgcaggaaattgacatattcgttcagtccgaattcattgaaatattcaaaggttaaatcttccttgaactccttgaggtgatttttaacggctgcaaacttttcgtatgtggattcagtccagttattctggttgccgcattcttttacaaattcatcgaatacctcccaaaaacttatctttacgtcttcctggtcttcacttgtatctttcatccgcaggttgaatgcgtcctttagctgttgggtagtgggcatggcttcctgtacctcaaattccttgaacacgttttgaatttcggtatagtatttcagcagatcggcattgatttcagatgcactttgctttagtttgttggtacacccgttcttcactcgctgcttgtcagcatcccacttggctacatcaatgcggtaacccgttgtaaactcaatgcgctgacttgcgtatatgacacgcatacggataggcacgttctccacgattggcacaccgttcttcttccggctttccaatgcaaaaatgatgtttcgtttgatattcataattgggtgtgtttgaaattctacacccaaatatacacccaatatttggaatagcaaaagatattcagaaagatttagatttactatgtactccaaatagtgcttgattattaatgatttgcaattttatgatatttcttgaatatgtaggttcgagagcctgtctctccgctggaaagaattgcaaaacgaagaaaatccctgtaaattaatactttacagggattttttgtttttggtgcatagcaaaaataagcatatcaaagcattctttcggtgtactattcggtgtacctgatctccttcaatgtcaggtacacctattaagtaaataattcattgtttatcagtgttttgcatcttgacttgttgctcttggaattttagttttgtgattaaaaaacaagtaagatggaaagaacaacattttgtctattgttctacattcgtaggacgaaattgaatcggaacggtgaggctccgataatgatgagaattacagtgaatggagtccgggttgatgcttcagtgaagaaaacaattcttccggaattttggagtgtagcaaaaggaaaggccctggaaaagaagcgtgagtacaaggaactgaatctgtatcttgattctatccgtttgaggataatgaaaattcagcgtgaactggaaatagaaggtgtagcggtttctgccggcagtgtcctggaccgtttttggggtaaggatgctcccgtacagcgtaccctgtttgaggttttccgtgaacataatgataaatgcgcccaattgtccggtacggacatggcgcctgcaaccgtgcagcgttatgagacatccttgaaacatactcaggattttgtctgggagacatatcataaaaaagatattcttttggatgaagtttcccgccagtttgttgaggattacgagttctggcttaagacctcgaaaaagtgttgtcataatacagccaccaagtatctgaagaacttcaagaagattatccgtatcgctttggccaagggatggatgaagaatgatccgtttttggaaatcaggttctcgttggataaggtggagccggacttcttggaagattcggaaatccgaaaactgatttcaaaggagattgatattccgcggctgggtcaggtacgggacatttttgtgttctgttgcttcaccggtctggccttctcggatattcacggattgggaaaggagcatatcgtggaggactcgaacggtgtcagatggatacgcaagggaaggcagaagaccaaaatcatgtgtaacatcccattgatggaagttccgttaaaaatattggagaagtattccaccaatgaatattgcaggaaacatggtgtgctttttccggtgctttgtaatcaaaaaatgaacgcctatctcaaggagctggctgatatttgtggcataaaaaaaacattgaccacccatgtggcaagccatagtgtattttcttttttcttaaaaatcaatagcttacaaaatatcccagtttgacaggtaacgatttagaaaccagcgaaaatctgtattccacttcgttttgcagtaattcaaaagaacgccttttagcattacaaagataggcattataattggattataataggttttagcctacaaaaagtgaattccatatatttttattgctcaattactgctaacttcactaaaaatgagtaattttgtactttaataagtatgagtgttaccatggttgtaaaaacaataaaattgacatcactatttgtcaatactgaaaattatagatttgagcctctgtcttcacaaaaggaagcgatagacaagatggtagaggaccaaggggataaattatattctcttgtagacgatattgtaactaatggtcttagtccagtcgatttaatcattgtaacgcctaacgaagataacaacaaatatatagtactcgaaggtaataggagaataacatcattaaaattattaaacaatccaacattaattgatgacaagtacatttctttaaggaaaaaatttcagaaattgcaaaaagaaaatcctaatgctatttctgaattgaagaatattgcttgcgctgtttttgaaaacccaacggaagctgatatttggataaaacgtaaacactcgggagagctgaatggtatcggtacagttacttggaatgctcaacaaaagcaaagattcgaggagaagacagaaggaaaatcatcgattccattgcaaattatcactttattgaaatcacaagataatgtttctgatacgattaaggattcgttatccaaactaaatattaccaacctgcaacgtttgatgtcagacccttatgttagagaacaccttggtttgggaattaacaatggaactttagtttcaaaggttgaagtgtcagaagtcgtcaaggggcttataaaagttgttacggatattcttaatccagaattcaaagtttcagaaatctataatagagaaaaaaggaagcaatatattgacaattttgacacgaaccaaaagccagacctatctaatgaagcgtctgaacaatggagtgttcaagatattgtagacaataaagggcaggtattaataaatagtgaacgcagagaaataaaaaaggctaataatcagaaagctagaaacagagctggcttagtgcccaagactttgattttgcatatcaacaaccccaaaatcaataaaatttttgaggagttaaaacatatccaagttaaaacatgtcctaatgcatcttctgtactgctgagagtgtttttagaattgtcagttgatgcttatttggaaagatatgatttggtaaaaaacaatgctataactgcgtgttcttccaaagaggatttgaacgggaaagtttgtaaagtattaaatcatatgacccaattaggaacaatgagtaatgatttatctaaaggtataaggtctgaaataaatgataaaaattcagtcctatccattgaatccttgaatgcatatgttcataatgagtttttctatcctaaagcagacaatttgattataggatgggacaacatagaaagtttttttatccaattatgggaatctataaataaagaatgacattatggagtttttatcacctttaagatatcccggtggaaaggcaaaagtcgctgatttcgtacagtgtttaatcaaagaaaatgcattgcttgatggtacttatgttgagccatatgtaggaggtggttctgttgctttatccttgctctttaatgaatatgttagtgatatatatataaacgataaagacatatctatttatgccttttggtatagtgttcttaataacacggatgctctttgccaattaattaaggatactcccataaatgtcgaaacatggtttaagcaaaaagagtttcagcagaataaagaaaatagaaatgttgatttattaaatttagggttttccactttcttcctaaatagaacaaatcgttcaggaattttaaaagctggaatcataggtggatacgaccaaactggaaattacaagattgatgcgaggtttaacaaagaagatttgataaaaaggattcaacgtatagcagactacgcggagagaattcatctaacaaatgacgatgctgttactttagtgcaacgattaaaagatgaattaccttacaatactctattatatttagacccgccatactatataaaaggaaaagggctttatctgaactactataatgacacagaccatcaaaacatcgcaaatgctataggtgcaatagtaaattgtaagtggattgtctcttatgataatgtgccattcataaccaacctatattcaaaatataggcaacaatgttttgaattgaattatagtgcgagtaactcaggaaaaggtgaagaaataatgatattttgtgacgatatagttattcccaaacacaaattatttaatcattcaacaaagtgaaaataactcacattcatatcgaaaggtttcgaggcttccaaaatgaagactttgaagtaggctctcaattaacagcaattgcaggacaaaacggaactcaaaagtcaacattactgggtattgtaacacaaaccttcactcttaagcctgaggatccaatgagagcggaaaaacctttgtgtggtggtagctatatttctgcattcaaagataagtttagattatcgcccatttttgatagacctaaaggtcatgaatggaccatttcttttgatataggagtagatgactttactgtcgaaagcatcaaacgtactggagaccctaatgtgcgattttggaagaaaggagcaaggcaagaaggggatggatatatctcctttcccacaatctttttaagtttaaagcggttagttcctatggcagaggaggccaagattataactgatgacacattattaactccagaggaactaagtgagtttaaacaattacacaataaaattctaatagtacaaactcccatttcttctgcaacaacaataacctcaaaaaataagcaatctataggcgtatccactgaattatacgattggaatcaaaactctatgggacaagataatctgggcaaaattatcttggcattattttcttttaaaagattgcatgacaaatatccccaacaatataaaggtggaattcttgccattgatgagatggatgctacaatgtatccagcgtctcaagttgagctattaaagattttgcgcaaatatgcgtctaaacttaatttgcaaattttatttactactcattcaatgtctcttcttaaggttatggacgatttagttcaagaagtaagtaaacaagaagaaacagctaagtaggtaaagattctttatctaaagaaagtcgatgacaagataacaatcaaacaaaatgtagattttaaaggtattaaattggatttgaatgttgttgcagaaggaaaaaaacgtaagaaaaacaaaattactgtatatacagaggataatgaaaatatattattcgttaaagctattttaaagactaaagcatctatattagattttgtagatgtaactctgccgtgttcaaccttaactgaacttgtaaataaaaacatacctgcatttaaacacccatattctatcatcatattggatggagatgttaggatgaatagggcgtatcttaagaaaataaaaaatgcagataacattttaatattgccagggaacaactctcctgaaagactgctggcatcctatttgtataatctctctgatgcagatccattatggggcaatatagcaaatggatataccaaacaattatgtttccgagactatactatggaacaaataaatgcaggaggtgagttggggcgtcaagatgcaaaaaaatggtttaatggtcagttggaatattggggacgaaatggtaataaggtttttaatccctttttacgttcgattcctatcgaagtacaagagtttaaaagaaattttgaaaatatgataaaacggtatatttatgactaaacttccggtgaccacaataaaggagcttaaatgccgaaagtattctttgggttcttggtcgatatataatcagaatcagactttctctttcattaaccgaataagatactgtttcttttagagcttttgctcaggcacactcagtgaaacagtgtctgattatcagttatgattgcttgaatttatatttaagtccatactcttcaagtttactgtatagtgtagctctgcttattcccaacagttcggcggcggcactccggttgccgtttgtctgctttaacgcacgcattatccgctccttatcctccgcatcattgcgcagggcgaagctgacaggtgaggtcggtttcgtcacggcaagttcaagatgctctttcgtgaccacaccttcctgagcctgcaacacggctcccatgattttctgccgaagctcccgcacgttgcccggccatgcgtgggtcagcaacgctttacgggcttcggaactgaaaccgctcacattgcactccagttccttgttggctatctcgcggaagaactccgccaacggcatgatgtcctcctgacagtcacgcaagggcggcacggttatcacgaagtcttgcagacggtagagtaaatcctgccggaaacgcttttcgctcactgccgcctccagatcctcgttggtggcggcgatgatgcggacgttgaaactcttgtccgatttgtcaccgaccgggcgataccgcctctcctgtatggcacggagcaacatctgctgggtctccaacgcaaggttgcccacctcgtcaagaaacagcgtgcctccttccgcctcatggaaatatcctttcttggtgctgtccgcacccgtgaacgcgcctttgacgtgtccgaagaaagccgacggcgcaagttctctggatagcgaaccgcagtccaccgccacgaagggcttgccagcccgtttgctcttgtcgtgcagatggtgggcgatatgctccttgcctgtgccgttctctccgaatatcatcacgctcatgtcggtgacggctaccaactttatcctgtgcatgattttctgaaaggcggaaccttcacgggcgaaaacgggcatccggctgtgtctcgactgacgctctttctgtatggagcggataagggggacgagtttgtcctctatcagtttcttcggaatatagtctatcgaaccgagtttcatgctttcgactgccgtatgcacttcggcgtagtcggtcattatgatgaacggctgcatctttccctccttgcgcatccagcgcagcaggtctattccgttgccatcgtttaggcgcaggtcagaaactactatatcatcatccgttgcctgttgcagatgtttcttcgctgttgacaggtggtaagccttcacggtactgtatccctcccgtgccagcagattgcagacatattcgcaatacacgatgttatcctccaccacgattattcttgtcttatccattttcgtattttctcctttcctcctttgccaactgtataatctccgctcctttatccaacacggtggtcacggaattacttaacgcctcgttatcggacttatcctttccatgaagcacaccataaagcaccttcagcggctggtcggcacggagtatctcccacgaactgcgtaagtggtgtgtcaaggcatcaagttcttgcagatcgtttcgcattgccgcatcccgtaccgcctgcatttctttctcggtttccgttatcagtttttccagcatgacaacttcattgccgtaggacaacaaggcggaaaaatccggtttaccgtcctgtgtcgctttaatggcgcacttgtcggaaatttccagcagttccgatatggagaatggtttgaacaggcatccggcaaagcctcgttccaaaagttcctccgcatcgcaactgcccgaagcggttgccacgaccacggggattgtctgtgaattgccaacattggacgatcggagcagttccagcagctcgaagccgtttatgccgggcatattcaagtccgtcagcaacaagttgtattcttttcggcgtatcatttccatcagttccgccgcatcggtgcaagtgtcgcaatgtattccctcctgtgcatacatctctttcaacatcaggagcagcacctcatcattgtcgatggcgacaacattgaggtttctctcctcccggtggatataagtctgtatctctttttccggtatttcttcggctttctgcatgggtatttccactgtgaaacgacttcctttccctttctcgctttccaaatggattttgccgtcaagcatcgccactatgttatgcacgatggcaagtccaagtccgaaaccgtcttttgcggcggcgtttgagaggcgttcaaatgccccaaatacacgttgctgttcatcttctgtcatgcctgtgcctgtatcctcgaaaatcagtgtcagcactccgttggtataatcgatagtcagcgacacaccgcctttctccgtgaacttgatggcatttgacagcagattgtttccaatttggatgattcgctccttgtcggtcagtacaaccgcatcgtttccgttctttacggtcaaggaaagccccttgttcatggcgacgggcatgaactccgtttcaagggtatgcgtgattgtggagatgcggcagggcaacagtttgggctgctccttgccgttgtccaagcggaagaagtccagcagggtgttaagcatatcccgcatacggtcggaagattgttgtatgctttgaagaaaattcacattgttctccttgctgcactctttctgtaacagctcagtataacctgttattgccgttagtggtgtgcgcagttcgtgggtgatggtatgtaccgctttcttccttgatgctatcagtgcctcgttccgttgtacggattgttccagttgccctatcaaatccgttgtcttgcgcttgtattgtttgatactctttgcatcacggtgtatgatgatgtaggaaattaacaacagcagaaggacgaatcccattaaaccgcctacctgcataaatgactttccacgcatggcaactatttcgtcttcccgcccttgcaggtcggcttgtaccttattttctatttgacagattagccccttcaactgcctgttaagatctgcattgcgggcggcaagactgtcggcttgttccgacaatcgacggctttgctctttctgttcactgaccatgcttctattgggtgaacgaagcgtagttgttgttgtcggcggcttcgtttcctcttttttgccgaatatgcccaagaacccttttcgtttcggtttcttgggctgttcctgcatacttgtctgaacaatgagaggtacttgactggcaatcttcttgttgatggattgttgttcgtctattaaccgaacaatctgaaacatctgccgttccttatcttccaaaagactgcgcacactgtcaatacgtccaattacatgagtttcattgaacaggcacaatgtgctgtccaatgcaatgcgttgggcatggtaattctccaaatccgtttcgtcccaatccaatgcagtttctcctaatagcgaaaactctatcagttggatatgaatacggtttacctccttcctgaattcatctatatgccggttgccaacctccaatgcttccacttcctgccattcattatgacaagtaaatgcaatggctactactattagaattatgaaagtgtgacttaatgctattgccttacgtacaaattccatctattctcttacgaattaaaatcgtcctcctcccaacgcgtgataaagtttgattacactttgtatgcgttcaaaacgagtttgcagctgttgcacttccgcttcaaggagagattgctgggcggtcaatacttccagataggtaatattggaatgacgcatcagtgattctgttttccgcacggcatcgcataatgtttccacctgccgagcattgatttcaagttgcgatttcgcagtctgccatgcggtcaaagcatcgtttacctctttgcctgcgttcaacaaagagtgttggaacagtaacttcgcttcttcctggcggatttgggcagtcttcaggttggcgatgtttgcgcctcgattgaacaagggctgtgtcagggaaccgatggcattgagcaaccattgtccgggattggtgattataccgccaccgttattggtccatccaagtgttcccgaaagggtgatatgggggtagaatgcggcacgtgccgcattggttgtgtagaacgcctgcgccagttccatttctgcctgacgcacatcgggacggttggaaagtaactgcaaggggactccgatagagacggtatcggggaaagctgcttcgaccagattacttcgtgctattgagtgtgacggcatggcaagtattgcaaacaaggcgttttctgtttcggagatgctcttgcggatggataatagggacgattcgagctgcatcacgttcgcttttgcctgcaatacaccggcttcgtttgactgtccggcttttttcaatgcttcgagagtgcgcacggtagtctgccagttttcaagggtgcggtggcttattgccatttgcgcgtcgagcatggcaagggtatagtaactgtcggcaatagtggcgacaagctgagtctgtacggcttgccggtaatcacggcttccttgcaaggcggcagcggcaccacgttttgcagctgtgaggttgccgaagatgtccagttcccagcttgctgtcgctcctgcattatatgtctttgccgttgctccatcgtgcttgccggcattaccttcggcattcagtccgagtgagggtagataggagagtttagctgtcagcaaggcggaggctgccgcttccacccgtagccgtgccacattgaggtctgtgtttcggtcaagtcctgtttcaatcaaggactgaagtttagggtcggtaaacatttcccgccacgacagggaggccagagtggtggtatcggcgtctgccggaagggtgctatacagattctccatcgagaggtcggggcgatgataccggctgtacgtgccacagccggtaagcatccatcctgacaatatgatatatattgctgtctttttcatttaattatgcttaatacgttcttggatatattggaagacgatgaacaatgaaggcacgaggaacaacagagccaatgtacctacaatcattccgccgattacacctgtggcaagcgaacggctaccgttggcacccactccgtgagccagcatcagcgggataaggccgaacaccatagacaacacggtcatcaggatggggcgcagacggacttttgccgcactgtatgccgcttgtgccagtgtcatgccttccgaccgccgcttgcctgcatattcggtaagcaggatggcggtcttggcaagcaggccgataatcataatcagaccggtctgcatgtagatgttgttctccagaccgaagagccatgcgaacaggaaactgcccatcaacccgcaaggcactgccagcagaaccgcaaagggaataaacacgctttcgtacaaggcacacagaatcatatagaccaggaccatacagagcaggaatatcagcgtggcattgttggttgtcttgctctcctcgcgcgagatgccgccaaactcgtaggtgtaatttgccgggagaaccttgcgtgccgtctcactgatggcttcgagcacctgccccgaactgtaaccccgggccggagacccattgatggagatggcattgaacaggttgaagcgggtgaggtctgacggaccgttggtcttggtcagacgcacgaaccggctcaacggtgccatgccgccatcagaggtgcgtacatagatatgatgaatggactctgcattcacacggtattccgccggagcctgcatggtgacgtggtagagcttggagaagcgattgaagtcggaaacatattgtccggtataatagcccgacagggtggaaagcacctctgcgggcgacactcccgactgctcgcatttggcggcgtcgatatccacccagtattgcggatagtctgtggcaaaggaggaatagacttcgcctatttcgggccgctgcgacaaggcctcgacaaacttgtccgcctctttcttgaaagcggtaatgtctccgcctgccttgtcctgcaagtagagctcaaagccgttccccatgccatatccggctatcattgggggcgacatggcaaacaccgtggcatcagggatgtcggaggtggcggcatagatttttccgatgacgtcgttgaccgactgcccctctccctcacgctgttcccagtctttgagtgtcacgaaatacatggcctgcgacggaccggaaccgctgaaagagaagccggcaaccgcaccgttgtattctatctcgccgatactgtcgaggcggctgttgatgcgctccatcaccttgacggtctgcgccattgacgtgccgggcttcgtattcatgctcaccatgaccgttccggtgtcttcttcggggataaggcccgtcttggtggcgttgaccagcagcaccagcaatacaaaggacactgctatagagctccacatcagccaccggcggtggaggatgaacatcactccacgcacatagcgtcggctcagacggtagaaaacggcattgaacgcctttcggaaacgggctgcaaagttgtcctttgtattgccgtgctcgtcgatatagggcttcagcaacagggcgcaaagtgccggtgagagggtgaaggcattgatggccgagatgcccacggcaaccgccatcgtgatgccgaactgcgcatagaaggctcccgaagtgccgcccatcatggcaacgggaaagaacactgccataaagatgatggtagaggtcagaatggccgatgaaacgtctttcatggcatcatcggccgcaagcaccgccgactggtagccctcatcaaacttcgcctgcaccgcttccaccaccacgatggcatcgtcgaccacggtgccgatggcaagcacaagcgcaaacagggtgagcaggttgatggaaaagcctatcatggacatcacggcgaacgtgccgatgatggaaacgaagatggatatggcaggaataagcgttgacttgatgtcctgcaagaatacatataccactacgataaccagcagtatcgcctccagcaaggtgcggatgaccgagcggatggaggcatacagaaacttgttggtgtcggtaagcactacgaattccgctccttcgggcaggtcacggtccagttcgtggagcacttcgtgaatctcgttgatggtgctcgacgcattggaccctgccttctggtttatcatcatcatggctgccggatggccgttcacttgggaggagtagttgtagtattcatcgcccagctccacatcggcaacctctttcagccgaagcacgttgccacccggcaaggacttgactaccagttcgccaaactcatcggcaccggacaagcgtccgcggtacttcattgtgtattcgttggccgtggggtgattggcaccgaaggagccggtggcggcttcgatgttctgccgcgcgagtacggcggatatgtcgtcgggtatgagcccgtattgcgccatacggtcgggcttcagccagaggcgcatgctgtaattggagccgaacagttgcgcctttcccacgccgctgatgcgcttcagtcgcggttcgacattgattttcatgtagttgttcagaaacgtctggtcgaagcggtcatcgggcgagtagagggcaaaggtcagcagctcggcattctgctgcttttcggtggtgacaccggtcttggtggcttctgccggaagctggctcaatgcggcgttcacacggttctgcacgttcacggctgccatgtcggcattggctccttgcttgaagtagatgttgatggaggcgtctcccgtgttcgatgccgtggaggtcatataggtcatgtcttccacgccgttgatggcttcttccagcggcactatcacggctttctgcacggtttcggcgttggctccgggataggatgcccatacattgatggtgggcggggcgatgtcgggatattgctccaccggcagggagaacatggcgatgacgcccaacagcacaatcaccaccgagataacgcccgagaacaccgggcggtctataaaaaatcgtagcttcatttcgtttcgtctttaggggttatgctcatgccttctctcaccagtcccacgccttcggcgatgagggtgtcgccgaccgagagaccttcttttacgataaaccggttgccatcgttcaggcggtccaccgtgagataggcagcttccgcccgtccgtttttcagtcggtaggcgatgattttgtcttgcagttccacggtggcggtcatgggaatggtgatggcatccgtttgggggttccgaaggacgatgttgccgatgctgccgctcagcagttcgcgttcgggattggggaacagggctttgatctgcaccgctccggtcgcagggtccaccacaccgcttacggtctcgatgcgtcccttcgctttgtacagactaccgtcgttgagttgcaggctcacttccggcatcttggctatcaggctgtcaatcgagccgtagcgagtggataggtgtcgcagcatgttttccgacacggagaagtaggcatacatctccgcattgtcggacacgaccgtgaaaggctgctccatgttgggactgacaagcgcaccgatgcggtagggcaatgtgcctaccacgccgttactcggacttttgatttcagtataagagaggttgtttcgtgcatccgcttcctgcgcctcggcctgttggagttcggcaagtgccacagctagttggtttcgggcaagagaaaggtcgtattcggatattaccttctcatcaaacaaggcttgcttaccttgcagttcgattcgtgccgtttccgcttttgcccgtgctgcgctgacattagccaaagctgtgcgtaaggctgccagatagggtgtttggtctatcactgccagtacttgccctgtcgtcacccgtgtgccctccttcacgcatagacgcgtgatgcggccggatatttgcggcatgatatccacatcttgtcgcccgcggatagtggcggaataagattcggatatttccaccggcatggacgatactgttatgacccgataactcggtaccgcatcctgcttaccgtcctgcttgcatccagtcgacagaaacagcatgacggcaaatgcggcgaaattaatgataatgaatcgcttgttcatattcttttcttgttcttaattattcgtaattgatttagcactgattgaattccattctttttttagaatggaataaacacgggtatcttcatatttcggggtgccgttaggattgtttataaatgtcacaaattccttgaagcatccttcgcggcgcataccaaggcgttcgcataagcgtttggagcgaatattgtcatcttccacaaatccatagatacgccgtgcacccgcctcccgaaaaagataatccaacaatccgataaccgcttcacgagctaatcctttgccctcaaaacgtttgttgaaatgccagcccacattgtaagtatcttcattttcacgcaaaacgaaaacatcaccgattataaagtcctcctttttcaaactcactgcatagcgttgcatatctttttgggaatactgcatatatacgaatgccgcctcttcagaacaaaggcggtcggcggcaaagcaattcacacgaggatttgaaagatattccaaaagtccaacaacgtctctcttttgaaagtctctgattacaagacgttctgtttcaattttcatacacttttttttgagatgcaaaattatacccctataaaagttcttgcaattcaaagagtatcgaagcggataaattaaagtccgaactatccaaactgacagttaagaccgaaaaaaggataatctttcaagtgcagatcggttttaacaaatacaatgtgtatttcaccaatagttattatcgtttcgatagtaattttatccgtttcagcctgtttatcctatcaaccaaaggagtaaagccttatctttgccgaatcaagagtaactttgcacccgatatgacccaagtgaaaatgaaaataatgagttggaagaacggcctgttgctatctgccgtctcctatgtattctaccttgtcatgtggtttatactcgatgacaagaccatcgaccaattgccgggaatgacaatcgctgattacatggtcgattttctgctgtgtatgctttttacctacatatccttaggattctgttttctggtcttcagggtattgccgttcaggacatcctacgtgtggggaatggtctatgcatcctgcctaatggcactgaacaatatcgttgcgttcggtatgataaccttgttcaatttcctatgggacgaaaccgacaacgggcttctcgacgaactcctcaacatgaaaggcgcatacacctttgccatgatatctaccttcctgtcaagcgtctatgccaactccttctaccttcagtcttacatcaaggcgcgcgacgagaaacaagcactcgaaatggcgctgatgaaggaaaaagagatcgccttgcagtcgcaactcaactcgctgaaactgcaaatcaacccgcacttcatgttcaacaacttcaacaacctgctggaactgattgaggaagataccgagcttgccggaaaattcctgagtaacctatcgaaagcgtaccgatacatcatcaccaatctggaccgcaatctgatacccgttgccgacgaaatcaagtttcttgattcatacttgtatttgatgaaagtacgccacaacgaaggggtcattgcaaaagtaagtccgggcgtcagacaatgcaaaggttttcttcctccggctgtattgcagcttcttgtagaaaacgcaataaaacacaacagcttttcatctgaacatccgttggttatcaacataaagttgtccgatgattacataaccgtctgcaacctgaaacgacctttgatgtccccaatcgaatcaaccggtttaggacttaaaaatatcatagaacgatatgctttactttgtgataaaaaggtcaagatagagaatgccgaaaacttctattcggtaagtctgcccatcataaaaaacatcaacccttatgaaaatactgattcttgaagacgaacagcgcaatgccaaacgcctcataaggctgctgaacgatattgacagaacatttattgttgaaggtccgcttgccagcatcaaagaaacagtcgaattctttcaatctggcaaaaccacagacctcatccttgctgatatccggctaactgacggtttgagtttcgaggctcttaaacatgcccaggcaaccgttcccatcatatttaccaccgcatacgatgaatatgcagtacaggcattcaagttcaacagttttgactatcttctgaaaccgctggatccggatgaacttgaagcggccattgacaaggcagtcaaagccggaaagaattataccgacgaaaacttgcaacagctttttgacgccttacagaagagcaagttccgttatagggagcgtttcctgcttccttatcgtgacggatataagaccgtgcgagtttcggacatcaaccatatcgaaacagaaaacaagattgtacatcttcgtctcaacaatggcacttccgaagtggtcaatgtgtcaatggatgaacttgaacaccaactgaacccggactatttcttccgggcaaaccgccaatatatcatcaatgtagagcacgttttgttcctcggtaattattttggaggaaagttgattgtccgtttgaaaggttatccgaagacggaaatacaagtgagcaaggaaaaggcgcagaggcttaaagaatggattgacaggtagactattcttgcaaaaagagtatcaaatatatttagtttgtaaatcaagtatctagatttctatttatcagttagaaagccagatacttgattctactatattttcatccctttcagttagttcttattcttaacagatgtccgacaatgacatggtcggcaatgaagttacccgtcggacttcgttcacttgccgaactgcgaaccaaagggacatccagctataccatagaatcatcccgtctttgttgccacttagcctccatttctcttgaaagctccattatctcccggctcagcttcacaaggtcgatggtgcactcctccagcttgtagagcaacgccatcgccttcttctccgagaagtggatgcgcagctccttgacgacctgattgtagttcgtgcctatgccacggaactgggcatggaaatccgacagcttggtgtagtagtccaccagcgtcttgtccactttcagcaccttgaacttctgtccgaagaagtgcgccttgagaaagacggctttcgcgtacacgttagattcctcgtacatcgtcaggaatctgttccattccacatcatcgaagcgcaccatcacgcagtgcgtcttcgggttcaacttgggatttctcccgtacttgctcttctttttcatacttcttattttttcaattttatggcttgtccattgtttaatctttgattaatgaaccccgaaattatccgactgcggaggataattctgcccacggcggtgaaggtgttttcagttacttagaattattcgggtaactgaaaatatatcttgctatgtctttgaagacataacaatcctccgcttgtcggattgttttccgagtgtaatcactcatcttgggtatcggttaagccgatgaagtgtattcaccagcctaaccgactttctgtaatcccgtcagagcttgcgccactgctcgatgtcgttccgataggtgtcgaggtgcaggcggacgaggttttcaatcagccccgatgcgctcataccctttcctccgaggaagcggacaaccctgtccagttcgtcacgcaccgtctcgctgacaaacacgggcttgcggttgataatcttggggacttggagataggtggcgcggtactcctccagcgacagcctgcgctgcttgctgctgacacgcttctgcggcattgctgtttccccgaccgcctcacttgacggttcatccgccatagcggtctccgtttcttccgtgacggtcttgccgggctgttccggctcatccggctccaggccgatacgcctgtagatgtcattcatcgacttgggagtgtaggattccctgcgtcccatcttttccacgatttcacgagcctgctgctctgtaatgcttggttctctcttcattgtaaaaaacaaattgattaagttattaactgtggtcttggtaagcacctcgaccgattatcgggagcaaagtaagatgcttcagtgcagtctgtcaagcacttgggttctcttaggcaattttgtatggttttgctttatggtgatagaaataacggtgcagacttcaccgttttgccggatgtatataaccgaaagggaaaaaggtttagttacgggtgattttgaattaagctcttatttgggctgtggtgtccttattaaatataggaattaagggctaaggactgggcggattgggcaatcggtgaaccatgcctgtgccaacctctaccaccctgtgccacttgctgccagaccaaattgaatccattgccggatgccggattatgtatttctttgcgggagaaggaatgatagccgccaaaggaaaagtcggtatcacggacaatgactaccgtatcagcgcaacatgctaccacttccgggaaacccattgtcaagtaacggattatacattcctttgcggcataagaaacagtaacaactaaaaaaagacaatatggaaatcgtatcaatcgaaagaaagacctttgaggagctggtcgccaagttcgaccgcttcgtctgccgtatggatgccatctgccatcggcacggcgaaaagaaaatgagcgagtggatggataatcaggacgtatgccggatgctcaatatcagcccacgaaccttgcagacgcttcgggacaatgggactttggcatacagccaaatcaaccacaagacctattaccgtcccgaagatgtgcaacgtatcgtctccatcgtggaggacagacggaaggaagcaaagttcaaaggcaggacaatctgataaccgaatagagtaatgacaataattccactaaatccagagtaatatgaacgaactgattaacaaagacaacgagtggataatccacttcatgggcagtcttgaccgtctgctggacaacgtagagcatctgactgccagctaccgcccgacactgaacggggagcgtttcttcacggacaaggaggtgtcggcacggttgaaagtgagccgccgaacacttcaggattaccgcaacgaagggcggatagcctacattcagttgggcggcaaaatcctctaccgagagtccgacatcgaaaggatgctgactgacagctaccgtaccgcctaccgacagacggctatctgattttcttgaaagagcgcagtttgccgtctgccctatgtttgcgacagcaatggtacaataaaaaaggaacggcttacggatgaagcatcaatgtttagcttcgtctgtaagccgttccttctctttcttctgatttcccgtcagtcgcttgtttccgttgccggatgcccaaaatgcgtgtggttggcaggggcaaggttttcgggctgaatacgctcaaccccgttgaggaagattctgcccgaaacggctatgccgcccgaccttgccaatgctgtcagagccacacgctacctttgcatccgtgcatcgggaacaggtggctgacgggaagaacctcgactataccataggttgccattcttaccataggaaacaaacaatgtaaccgggattcctttcttggtggtgcagatttcatttattacgaaccgcctgaacaaaagggtctctttgctacatattctgaaagcgatggctataatcatttcaaaattatacacatcataactgatgccgtcagtttgcttgatatacttcatcgtatcagtttcgttcaactctttgttcttgtaaattgcctgtatcatcttgcggatattgcaagagaacaccccgaacaggtcggctatctcgaactgggtcatccacactggggctgtcggtacggtgaccgctcccattttactgattgttattatttctctgctcataatccctttattttatgatgattatatactgttttctttcttttcgccagccgatattttctttcttcgctccatcagtttgtccatgtctttggagattttatcatcggttatccgtgcatacccctgagtagttctgatgttggaatgtcccatcatcttggcgatgctctcaatcggtatatccgctgaaatcaggaaagttccgaagctgtgccgactttggtgatagctcagattttcctccttgcctatggcaacacccatctcgtggatgtcaaaccaaagtgaatcacggcttgggagaggaaacacgggcttctcatcatcggttgtgttgtacaacgacaatatctgttccgctatgggatgtaagggtatgaaagcctccacctttgtcttcttgcggttgatgcggatataccgtctgccctccgcattcgtcccgatatgatggggatgaagaagtttgatgtccacatacgccagtcccgtcagggtcgagaagatgaaagcccgtcttgccagttccatacgcttgtcatacatcggggtggaaagtatctttttgaactcatcgcggctgatgtacctgtgccttgcctccggcttcggttcatactccaagtcctcgcaggggttcacacggataatctccttatcgactgccaaatacaataaacgattaagccagcacatacatttgttggtttgggaagagctgaaattcttgcacttcttcaggaaagctttataggacttgccaaaatcctccgtcacttcttcaagaggaatttcctttttcccgattgacgctataaagtccgtcaggtatttctgataatacatggagtgacggtaggaagaagtggaatctatttcctcggaatgtttcttcaaccgctcccgttcccattcacccatttgcaataaggtagtcggatggatattattcagggaaatatggttcttcaacatttccgcactgaccactccttgcgatttaagtatctcggtataggcttcctcagtcagacgcaggtattcccgtaagcggttgttctccctgacggtctttatctcattcttcctgccgttccagtcttcggggcggcaatagatacctgtgcttatggcggtctgcttgccgtcaatggttatacggcagagtacggcggtcgtaccgtcagccctcaccttgctgcggttaatatatggcaataatgaaaatgtgcttcgcatattgttgttggatttatagggttagtttgaaatcttgtgtcgcctctatgaacttgtccatatcctcgaagagttttttcggactgacacgggcatatacttgagtggtggaaatgtcggaatgtcccagcatccggctgatggtctcaatcggcacacccgcttcgagcgttatcagcgaggcgaaactatgcctcgcctgatgatagcacaaatcatccttgatgccagccaatgccgccaacgccttcatgtgtcttctaagattaggccagcgtagtaaagggaacaatgtgtccctgtcctcactgtgatacttttcaatcagtgcaatcgcttcgggaagcaacttcacgcttgcccgatgttcgttcttcttcctgcggtatttcagccacaacgctccgttatcgtccgtgtacaagttctcatcggtaatggatatcacatccgcatacgagaccccggtataacacccgaagagaaacatatcccttgccagtatgtgagatttacgatgcggttcaatttccacatcacggattttctcgaacgattcacggctcaatgcccgtggggttttatccgactgcttgggcagggtgaaatgctggaaatggattttgtctgcatagccttccttataagccagacggcatatttttttcagtatggcaaggtgatgtcggacagtatctattgcataacccttattctccatagcgaaaacctgatagtcatggatgaactgttccgtaagctgcccaaatgctaaatccttgaccttgtactgatgcccaatgaactcaccaagtgtcagacgcatataatgataagtcgagtaagaagttttcgcacggtcaataccaatacgggctttgaggtcgtcacagacaacatcagtcattcgcatgagtgtcatctgcgtttccatacttccttgaaaatgattcttcacatcggtggcatcgaaatccattttacggctcacaaggttgtcaaaggcgttgtttaccgccaacaacagtttctcaatcttggtgttggtttccaccgcctccttgctcttgccattcagacggctttcacagggattccacagttcgggagggcatgacagcttgcatccgaactgcgccatcgtgcggttgacggtaatgcgtcccatgatgggagccttgcccgacttgtccagtccgctctttttgaggtagagcagcaccttgaatttttctactttcatacgcttatatttttaagtgcaaatttacttgccatataagcgtcccttgatgcgcaaaacactgtgtattaacgcaaacaaaacggtggggatttcttttcatcgctttccgttacctgttcccgtttcggtaactgcccggctaacggtttggtaactgaacaacctcaatattccgttgtcgtttgcattttttcaacttcgcaaaataccgaaatatcgcttattcctaacggtttacgtttaatctatacctgttcgctgttgcttgctttgccgtgtatattccatcttgcgcgtcatacttttgccacttttgccttggctaatggtgtttcgatagagagcgttgctaaaatgctggggcataccaatgttcagatgacccgtcattatgcgcgtgtgctggaccgtacagtgatacgtgagatgtcacagataaagatggattttcatttttccatgtaaggagagggtgtttggaatgagcaaaggcagacatgaggttcggatgcctgctctttcaggaatggccggagattgcttccggccttttttatttcattctggcgttttctgtctttttttggcggttgctcaacggttgagtaaccaatgacctcgtaatatctccgtaatattgcaccgtaaacaataaaaacaaggtcattatgaataacagaagaactgcacctggtgggcagatgacccacatgctcagtaccatactcgccaaagtaaccaacattgaaaagttactggctcctgccatacataacttgcccgacagcgagatactggattcaaaaggcgtgcgcctgcttaccaaaatgtccgacaggacacttctaagacgccgcaatgacggttcgttgcctttccaccgtgacaaggggaagatttactatcgccgttcggacgtgctgcgtgccatgctgctggaaaaagaagaacactctaaaaataaaaggttatgagaaagatgattaaggttgaaagcggctcgttcgccgcactcgtgagaagttacaagaagtccctcaacatgttggccgtgctgcaacatatctgcgaggataactgtgtagaactctccatgctgcccgatgaggtttgtgagctgataaacctcgatccggcagagattgagaagcagcgtttgagcggacggctgcgttttgcggaagaggaaaacgggaccaggcattattcgattgtggatataatcaatctgaaggattccattgactggaaggttattaacagacaggtggagagcctttcctttgaggaagaggaatgacggagtgcccttcttcccattacagataagagtatggccggcagatcggatttatccgggtgccggccatacctttgtcatttcctgaaaagcggttctttacggcaaacttaggatatttttttcagtccgtttgacggggcggcaatttccattggggggacatgccttgccttccgtggcaggtccggtgtatcgtcactttcgcctgtcgctttctctccttttatttccgttccgtcatccgttccgctttcatgctcgcctgccggttttatggtaagctgtatttttcggttcagcgtggcaagttcctcattcagccgcttgatttccgcatccttgggccatgaagccgccacaatctcctgaaggaccgggatgtccttcgacagctctgcgttctccttttcccgtttctctatcatggcgggaatgcgttccagcgcattgatgaagttcatgacggccagtttcgggtctttggctatataaccgttgttgtaggtatatttgataccgtccagtccctcgaccatgaatttgttctgcaaggtctgtgtgtccccgtcacaaatcctctcggtacggacaaggatgcggaaatcggacagggttccgattttcatatagtcatcctccgtccgggcattccggttgattgcggcaagccggttgccgagtatctccacattgtccgaatccacaccgtccagtttcaggggattgggacggagtccggtttccgtatctgcgggcatcaccttgttgaaatattcccagtccctggtgaaacgcccgataaaggtgttgtttttttctattcccaaagtcctttcattcagcttgcctttcgcgtttcccttgttacggtagaatgcctgcctctcactttcgaggaccgccagtttcttgtccagcttggccttttccagcaggtcgtcgttgcccgaaaggatggccacgtattcgctgaaactgccgcctccgttttcgtcaatcgccccctcgtcaatggtacgggcggccagattgcggcttttgagctggttgatgaacacctgcttgttttgcagcaggttgaacttgtagctgtccagtgacttctccaccgcatagatatagcagtccaccttgttgccggcgtactgcttggcgatgatattgccttttcttaccgcccgtccgttgcgctgttccaggtcggacggccttcagggtatgtccagatgatggatggccacggcccgttcctgcgcgttgacacccgttcccagtttctgtgtggaaccgaaaaggaaacggatgcgcccggagttcatatccttgaacagttccttgcgtgcgttgtcgctgttcgcctcctgaatgaactttatctgcttttccgggatattatggtcttccacgagcttgcgcctgatttcactgtagatgttccactggtcgggtttataggtactcaagtctgaaaaaatgaactgtgtgcctttctggtcaagatatttatagtaatattccgcaatcttggccgcgcaatgggacgccttgtttcccggactgtcaccgtactgttggtctatcagccgcatgtcaagcgacatcttgttcgagtagttggtggcgatcagcatctgtgccttctcctccgcttcggacagaggctccctgtctatgtaggtcgcatccccggtttcggcgaactttatcagtttttgaatgaaaacctcctgctggggagtgggcggtatgtgatagagttgctcgttgagttccggtctgtcaacccccacgtcttcagcggtcttgtaatcggttatttccgcatagaaattggcgagttccggcaccttgataaaatagcggaaacgctctttctgcaccacctggttggtcactgaaaattcaaagtccgtgcttttcttcgcatagactgcggcccagccgtcaaagcaggtaatcccctgccgttccatttccttcggacggagatatttgaaaaggagatagagttctgtcaggctgttggagatggtcgtaccggacaagaaagtggcccccaaatccctgcccgtacgctcctgtatggtacggatggcgaaaagcatgttcatggccttcatgcttccttcgggattgcccaggccggaaactcttgcatggcgtgtgttgaacatcaggttcttgaaattgtgcgattcgtcaacgaagaggtggtcgatgcccatctgtctgaaatctgtaacatcatccgtccggtcctttatatcctgttccagcttttcaagtttggcctcaaggttttcctttcttttttccagccccttttttatccagccggtcacttcattgccctgctgctcgaatacggcgagattctcttcgatgctgtctatttcctgcgtatatattttctgctgtatttcgggggactggggtattttcccgaactggtcgtgtgtcaggatgatacagtcccagttgttattcttgatgtcatggaatattccgacacgcttctccggcgtaaagtcctccttgcccggatacagcactctggcattcggataggccctcttgaacgtgtcggctatgtcatgcacattgcttttgagtccgataatcatcggcttgttcgccagtccgagacgtttcatctcaaaggcggctatacacatgataagggttttgcccgtacctacctgatggtcgattatcccgcctccgttcatctttagcatccatacggcatttttctggctgtcgtacagggacggtatgcccagccctttcaggtcaaggaacgggaagctttgcagggaaccgtcgtaatcgggacgtacatagcagttgaacttgcggttgtacatgtccgcaaggttctgcttgaattcgggcagctgttcattcagccagccggtgaaggcggaacgtatctcgttgattttggtgtcggcaagctgtatggcctccgcatcccgtaccttaatgtcattgccctccttgtcctgtacggtcttggttatgtcgggtacggtgttgtgcagcgcatgtttcagcaggtcgtttccgtaatagcctctcttttcccctttcacataatatctgtcggtgatgttcgcgttggtgctctcgaagctcacgctgaattcgtcaatggattccgtatagtggatatgggtctttgtctcgaagaggtatccggcgaattcctcatatacggacatgggtatccaccgttcccccaggttgaagtcaagctgttcgaaacttatgggctccggtatggctttccgaagggcctccaatgattttctgctcgctccgtcatcgggatagtctctcagatggttctctatccattctgctttggcgatcacattgcccgctatgaaacggtccttgatttcatggctcttcatcatgggattgtagaagatgcgctcttccagctgttcgagcagttcctgcctgccgatgtcgctgagattctccatatattccagattgacctcgccgaacttgttcagggatgccgcaagggcttcctgcggtgtatccacatgtgtcacctcgttggcgttgaacgatacgggcacggtgaatatgtccgccttctgtatcttcccgttgacggaacgctccaatgagagcatttcccgtcctcctgcatccaacagcaggaacttggcgttgtcctttccgttcagctccctgaacatgcggtggaaacggtcatactgccggttcagttcctcccttagttccggctgttcggtttccgtttcggcttccgcattgtagagattgtggtaggcttcacggagcgggatatagtaggcggcccggtattgttgtgtgacagtcagcctgagcggatggaactgtatttcgggagtacccaatccctgcaaatatccgtattgctcaccggctttcacgagagagccgttcttgtattcggggcgtatttctccggtaaacggacgtggttccgtttcttttttccgttcttcctcgaaccgtagtctgcgttcctgccatttcgcttccgctgccgcctgttccccggtcatttcttcttgtgagacggcttcatcatacatgttcttttgcgagaacagattgaacatttccggttcgtttccttttcttttgcgggatgccgacgctgtccggcccggtaatggccggttttccatcatctgtacctccgtttcctcctcgtccgcataggcggcaaacagattaagcatgggttcataaggcttggtggaaaggagactttcttcctgcatctcctgccggtgctccactgctgttgtttccggtgcgacttccggtccggttttcagggcagtggaaacggtggaacgggacaggttttcttcataaagtttccggtcaagatggtttcccacatcttgggccaataatagcctgagatgttcggaaatggctccgatacccccttcatggataaaattcatggccggttgtccgtacatgtttttacccatggatacggaagtatggatgatatggtccaaatcggcatagctgttgttgatattgatactgcccgatataagacgggtttcaataaagttccgttccttttcggtcagttccgattttcgggtattcttctgcaatacgatcaggtcgctgcccacttccgtacccgcatcggtaaacagattgtccggcagacggatggtagaaacgagattggcatggtttaccagccactccctgacgggacggttctgtggcgagtccatgacgcccgaagtcgtgatataggccagtatcccgccttcgcgcagcgtatccatgcctttgagaaagaaatagttgtgtacggcagcgagtgaggatttgcgcaccgggtcgtcactccggtcaaagtcccggtcataaatcctggtattcccaaacgggatattggatgagaccatgtcgaagtagccgttataataaggctgtatggactggaaaccctctatgttcaccttgcttttcggatagagggatgagagtatccttcccgtcagcctgtccttctcgaaacaatggatttcggggacatctttcagagtgctgatgaacatgcccgttccggcggaagggtcaagaaaacgttccgggcggatttccggtatcagcagggcttcctgcatggccgttaccaccggttcaggtgtgtaaaaggctgtgaggacggaattcttaagacttttgacgtatgacttgtattctttctcgtctttggaatactcacgcagaagttcatgcagcagccggacctggggaaacagttctttgtccgaccttcatttttctatgtccgtatctttctccgccggattcaggatgcacttcagtcctccgaaacccgaataaccgttcaagaccttgcgtccctgttccgtaagacagaactccggacgcatgaatattagttcaagtgcggctatgttgtccgccagatgttgtcgtctgttatacgccatattgttctatataagattgtatgaaacctgtaagttcaacggtaagtgtatgacaggccggagatgattcaaacctgtcgtctatggaatatttgccgaataccgcctctgcgggtgacaataccttcaggcagaaatccgtccgtctttcgggccgtacttcgggaaaccactccgatacaacctcgaaaaccgtatcgaaccgggaaaagcgcaagtcctgatagagaacggcgtcagcttgttccaaagcctgcctgacggataggccgtcacgtatggcatgttcgtaagcctctgcggcactgtccgcccgctcccggatgaatcccttgtcatcggccatgtgtggatggctttctctcaaataaaaaaggagagctgacttgaagcaggacagttctccgttgttgtcatgttgtgtaatcatcatctgttgtcattggattttgaatggggaaataatttgtgacatacccggtaacctgagaggaaaccgggtatatggattcggtaaacgttccgcctgctgccggattacgagaacgagaggctgttctttctggcctgcggtctgggagatacgacatggcgggccgtctgctttgtttcttgtttcctgtcgttttttggggtttcaaccgccggcttgtattcacgggcattgcgtcctatgagcaggttgttgctcttgttgctgaaacgcacatcatccgagaacagctgtctggtcttgggattgcgcatgttctcgatgaataccatgccgtgattctccagtatctttttctgttcgggggttatcttggctcctaaaatcgtatcgctgaccttcagctgcttgtcggactgtttgaatgcgatgtccctgatggtcggatcgacataggccacaccggaaagcatggtgtcgttcttgcgctgtatgtcattgatggggacttcgccacctgaagcgagtatctgcttctgcttgtcgtccagtctcttcccataaatgtagtccgggattttgatggcatccacgggcatggtgatgatgcggttggtggactcgtggaaactgacatagcatttgcatacatttcctgtaagcgtgtccttcatttccttgattcctcccaacgtacccgtttcggccagtttgtccttctcttcatccgtgaatacgcctttatagaccggcaaatcatattggggcttgtccagacgggtgagtgtcttgagttccactttgccgtccgcacctttcacacacatgaaacaggcctcgcccaaatctttcttttctccgtttatctccttgctgatgggcagtgcggtggaagtgattcttcctttgagaagttctcccatgcaatggttgttgaacagagtctccttgtcaagaccgagtgcgttcagatctttccacggcagctggtgctcatcaaacttataccgtcgggccagtttggcgatacgtccctcgtcgttgagttcgctgttttctaccagtttcttgccgtccggtccggggtcttcccctttcctaatctggatgaccgcgttcagtgtcttgtccaaaacggcaagtggtacaaggaagaaactgaagcttgtgggattttggtactggttcttgaaattcgtgaagaacagttccagaggtgtggtacggtccagtttgagaaaactgttgttgttctttttgtccggcggtacgacttcgatgctgccgtcctgttcgttcatcttggagatgactgcggtcttgttcgttctcttgtcaaggactgccattacatgctcatcctgactctgctcttgttgctcttgttttttcttagccataaaattaatagtttaagtgatacaataattaatcaataccgggtaaactttagcccgtcggtgcgaatgtagaagattaattgataatatgttatgattttatctgtatatggaatgaatggcgggaattgacgcaagatggcatatttgcaaatacttaatgaagaaactattttataaatatagagtattatatagttgttgacgagagttttattatctttgtaaatagagaaatatgataagtatggcaaatataatagacactgtaaatcagataggaagtgaggtttctgatgtattagaaaacaataaaacatctttgtattttcaagaaatatcattgctttgtagtcttacggaaaatttattaaaatatttagtagctacaaaagattgttgggatgcggtctgtaatcgagttgataaaaccattgagcaagaaaagaaaacaaaaagaaaatgcaaagatactgacttggatgttgattttcgattaataagaaaattgtctaaagatttagacttttatagtgctatcaatagagcttgttctttaggcttaatatctaatgatttgaaaattaaacttcataagttccgtaaagacagaaatgacttattgcatgaactttatttatttgaaaaaaggaatgatactgtttatatgagaaatagattattggaatgcgaaagtatagtaatggaacttgttcctgtttttgaaaatttaatttttgaagaaataggggttgatactccagaagtattagaaacattataaaaatatatggataaaaatgcacataagtctcatcattatataccacaatgttatttaaagaatttttctgaaaatggtatttgtttatttgtatacaacaaagattattcaaaatcatatgttcaagctataaataaaacttgttgtattaaagatttttatacattgcctaaaatatattgtgaaaatcaattagaacctctttttttagaatgtgagtattttgccaaagaaatagaacctaaatatagtgtattgcttaataaaatattagctaaagaaagagaatggatgcttaaccgttcaaataatataaaagtgttgagttccgaagaaaaatttgaatttgctaattatctaacaatccagtggtttcgaatgccacaaatgagaaattgcattaaagggataaatgatgatattatccctaaaatgattagactttttcaggaaggtatggccattgaaaataataatccggattttttaaaacttgatattggatataatattgatcctgtaatagaacatgcttcaagttcattttgtaatagtgatttgatttatgcttttgcaaaggctcttttctttaattcttgggaattttttgtatctgattctaattccatatatacatccgattatccattagtagtcgaaccacatgttcaaaatgtggttcaacaataccaagggttagccagttatggtagtgaactttcttttcctattagtaaaaatattattctaacaatttgggataataaatattttaagaataagcaacaatatgattgtaggtttactcctttgtcagataagggtacccgtagatacaattggatgagatatttctatgctaagcatcaaatattcagctataatgatgattttactattataaatcttgcaaaatcaataaatgggggaacacatctttttaaataatatggcactatccaaagttttgtgtaaatgagaaatatgggattctaataagagttctgtatttctcatttacacaatattatggacattgccaataatatttagttattttctccacataatagatgtttgagttccgggtcattctctatgcggatcagctcgttctctaccagttccacaatatcctgcttgatttgccggtagttggcctgtatctgctgctccattgtatcattgccggcctcgtccagaaagctgctgatttcaggaatgggttgataggcggctgtctctttctgtaccgcatcattatccactactatctgcgcatggaaaattttctggtctatcgtttctccgaaattgtccgttacggcacctacaaacataccttgtgaaagtgtactgattttgctggcaggtatcaggctgtccagttgcgtactgatggaagtggaagtgtcactgcggttgatactcatagactcccgtttttgcaggattttcccgaacctttccgacaatgttttggccgtttcacccaccacctggccgctgaatacattgcccacagttgacatgatgacggcggcctccttgtcaccgtagtcacgtttcaactggctgaagtcctgaaaacctaatacaaccgccaccttgttgcttcgtgccgtggcaatcagattgtccaaacctttaaagaaaatcgtgggtaactcgtcaataatcacacaacttttgagttgcttcttcttgtttatcagtttaacgattctcgaattataaagtcccaatgctgccccatagattgaaattctgtcgggattgttgcccacacataacactttcggttctttgggattattaatatccagcgtaaagtcactgccggacattacccagtagagttgcggacttatcagtctggataacgggattttagcacttgcaatctggccctggagctgttcgctcgccccgcctttccatgcgtcaatgaacggactcagatagttctcaagttcgggatagcttgtcagaatggtgaatacatcctcgtaccttttgtttagtagttctatcgcatgggggaatgtacagaacctgccgccttcatagattttcaaaaaccatattatcgccgtaaacaggacaatcggggattctacgaagaaatccccttgtttttgcacccacgacttattgaggttaagcattatggtgtacgacgactcgtaagcgtctgaaatatccgtcatcagttccggtgccagcgggttacagcgatggctcttgcgtgggttatcgaaatttatcacgtagaacttgggcggtatcttatagcggtgtctgtacttaatcagatggttataggcaataactgacaggtcatcaaatttaaagtcgtatatataaagagcataggacttctctattgcctgctttatgtaattattgaccacggcatacgattttccgctacccggtgtacctaaaatcatgctggcccggaaaggattcactacgtttatccagcctttccattcctttctcccgtaccagaatttggtcggcaggttaatggaatactcgttttccataaggcgggtttcctgcatgaacgattcattttcggtattgaaaacgtcctccagcaaattgttcttcaacagacggctaatccataaaccggatgccaacaggcagaagaaaccgccggccaatgtcgcggtataaagtatggcgcatacaccggatgatgcgtcaatggacagtaaccaccagttcaggaaaaagagtatggcacccgctatggccgcaatcattattttccttcatgtgatttcatgcttctttaccccctggttgcccatgcaggacagaccgaggaagaggacacaaaacagtttggtgtaaagaagggacgagaacagtcctgtggtacgctggaaattggacagtatcctgtccacaatatcaagcgtccagcccatttcgtgtagccagccgtaacaaaaccaatagatgtgtatcgccaaaaatagaaaactgacggcccgcataaagtccgtgactttggcaagacctcttaaatcatcttcattctgcataattgtaactgttaaaattcgactttttgttctataccttaattatattataatttgcgcctgcgcttcttctttttcctgcgtccgaagcggaaggccggatcgatgtactcgtgcgtatggtcatcttccatgagtagggagaaaatgtcaatggcaccgagtgcggacgtatcaatcagactgccggacggttcactctgatagccttgattttcctgctgccggtattccttcctttccagtctttcttccgtatcttgttcctgccggggtgtatcctgctccggcggtggtatcagccttgtacggtccgcatccggattgttgaacaattcgttgaacacattggctgaaaaggccttgcccagacgcgagccgttaagcactgtccggctggtatggtctatgaaagtgatgccgtacagacgtccttcgggattgatacggtaaaccgtctctatatccgcctctttcagcctgcgggcgaaatcctctttcgtgccgatgtcctgcatggctttaatgacttcctgtcttgtcctttcggcaaggctgttccttttcaccttttcagtagaagcggcaaacttcttttgcagtgcttcataaccgaatgccttaccgaacttgctggacttgaaaggtgttcccacctgctgtccgttatcatccaaagctccgtacataataccgtggtattccttcccgtccacacttcccctgacttcataaacggttacgttatacaggttcagaagagtgccatattcggcaagcgagtgacagttgtaacattccagcaaggttcgggcggtatgctttacctgtgctttcacgtcccctttcggataatccactttttgtagggatgatagttccctctcaccgtgttctccgaatgtgggatgaagcccgtacttcacttccatttcacggcagatgttctgtgcccggatagcttcccggttatggtctattttttctccggtttcatcaatacgtaccgatacgatgtgcatgtgcttgcggtctatgtcttcatgcagccatacgatatagggctggttcccgtaaccgaagttttctatgaactcctgagccagtacggtcatctgctcttccgaaagaatgtctttcggggacgggttcagggagatgtggataaccggtttccggacgtgcgagttgaatgcgatgtaaggttcaaaagcctgtacacagtgttcaatcggtacattgcccgaagtatccgccgctattttaggatgtcacaatacctttgccgtaccgtcatccacctttatcttattataggcaatcactccatagaatgaactgcccgatgtgatattcggcaccatgatgttattcctttttagtgagatactccttttcgtatcgctttgtcagttcgataatctgtttgcagagttcctccagtttgcgggtttcttcggccagtttataaaggaaggcaagcgatttcttttccccataaatggtatggatggtctttacacattggttgtagttgtttccgatacggcggaactgctgatagaaagcggtcagccgggcataatattcctgcgcttccttatcaatcctcactaccttgaactctcagccgaagatgcgggcaaagataaattcggccttgttcttcatgccggactgttcaaacatcgtgagaaacttctcgttctcactgtcattgagacagagataatagcggtgcgtacgcgggtccgccagcaccttgcgccctgcggcgctacggattcttgtttcatctttcataacatgaataatttaggaagttcgacttgggagaactgacatccccgaaaggcctttcggggcgggactttcagcggttggaaatattttcaaccgctgaaagtacacctcgctatatgctgacgcatattaaaatccggctgggccggattaaaggtctgaaggatttgtttgacgttctcttttcgagaacgggctgcgctctcccggcgacaaaggtagatagttttttcggtatggctattacccggtatcccgccaacagccgccaataaatgactttgaaaccacaggtgcctcacggatgctctttttgaggtttatttgcagccggatagctattcagctacttatttggatagataaaaaggtagttatcaggatagctatccggacggttttctatctgaatagctttctgtctgaatagccatttgattaagtatgttttcagacaggcattcataaggctatctatccgcttatacagctatgcatatataaagatgtatagacgggcaggtagatattcggataaatgaatatgtaaaaggactattagctaaatatttagacagacagccggatagctatatagctatatagctatataattgaatagctatgtaagtatgtagctaaatagacagatagctaaatagccatataactattaagctaaacggataatgaaatgactgaacggataagtggacaggtatctatccgcttaattatcaataaatcaaattatttacttaaaatcaggttacaatggaaaagagaaaggaaacggtattcatttcgttcgcttcccagaaggggggcgtaggtaaatcgacgtttacgatttatgcggcatcatgactgcattatgtgaaaggactgaacgtagcggtggtggattgcgactatccgcaacattcgattatgaaacagaaaaaacgggatatggaagtggtcaagactacacccgtttatcagaacctcttggtggagcaggccgggcggttgaagaaaaaggcgtatccggttattggaagcacacccgcggattgcatggcgcactgaagggcatttgaagagaaagcggatacgcattatgacgtggtgctattcgacttgcccggaacaatgggtagcgatggggttatcgccacaatcagttcgctcgattatctgttcgtgccgataaaggctgaccgactggtactggaaagcacgctgaactttgccaccaccattaatgaccggctgataaagaccggcgtgtccgctctgaaaagtcttcatctgttctggaacatggttgaccgcagggaacgcacgacattgtatgatgtgtatcagcaaggcttttctttgttagggttggattgtctcaaaacacgtattcccgtgcgcagcaactttaccaaagatttgtccgctacgggcggctccgtttaccggagtacgctgttcgctcctgatgcggcattcaccaaagagtgcggcttcgatacgtttatggatgaaatcatatccatacttaaaacctaataatcatggcaaagaaaacaagcggacagaatccggtggatgaagcgtacctgcgcagcctgatggcaggggttccgatagagcctcctttatcctccgcaccttcaaccggcggaggtaatggcgaaaatagagaaaccgctttatctgaggaaaagggaaaagcggatgacattgtgaatgaaacagtaagcggtatttccggttcggatgatgccggatgttcggcggttacggaaaaaccgtcaccgaaaacgattcgcacggcactggctgactttatacgcaagttccttacaccctacaaatgtgaaggcagacaaggggtgtatatagacaaggaactgcaccagaaaatatcggtcatcgtgggcattgccggaaaacggcagttgacggtaggaaactacatagacaatgtattgaaggagcatttcgagaaacatgcggatgaggtgaagacctatttacaaaagagttataacaaaatattttagggtatggatatacaatcaagttattatgaggccggaatcgttttgttctggctattgttcgcctatctgttcatggacaagttcgtattcaggggacagcttggcgagatatgtttcgggaaggcacgccgccgcatggcaaaagcgctgaggggtattgccgggtggttcgatccggtaaaggaggaacagaaaaaagggcgcaggcgcacgaaagggaaagcggaaaagaaagacctcccggacacgcatacggaagtgaaaaacgaggaaaaggcagagggcaggaacatggaaaaacctcctcagaaacggtctgaaacaggcagccttgtcgtgacaaaaagctacgggacacgccaacggccgccaataaacgccaccggttccggggctattgcaggtaaagaaaatgcctctacttttgctggcagaaacgaagatacagcgccacaaaaggcagcacaagtgccgccggagcgcattccggaactgttccgggacaagcgcgtggaagagtggcgggcttcttcggatgagagttccggcaagcgggatggcgatagcggacagggaggaaacggtgacgaagtggatacggacgagttgaacgaggaactggatgatttgaactgtatccgcgaagattattcgggcgaagcaaccggcatagggccggaagagatcgacctgattatcgacctctgcaacggcaaggatattccgacagacaaacgattgtcccttttaagggcgatccaccatatcaaagatacgcagattgaacgctcgatactggaaagtatcaatggcagcgacagccgtatcagcaaatttctggatgaagccgagcaaatgagcggggctgctccagacagtgattaaccgattaaaaaaggaggtaacaatgacaagaggttattttgatacgggttgacagcccgtatcactttaaagagagagattcgctatggtattaatgactgaataaaccaacaaaaccatgtatatgacttatttcgattcgggttgataaatggatgttcccgcctgataagggaacactccgggcaagaaaagacaatacctttggtaacttacttataaaacagaatggctatgacaaaaggctattacgattcgggatgacagaccgtctgcggcattcacccggtagggcaacaagaactattcaccattaaattttatccgtatgaatataggactggtagatgtggacggacataacttccccaattttgcgctgatgcgcctttcggcttattacaaggcaaaaggacatctggtggaatgggcgttaccggcacagcggtatgacaaggtactggcaagcaaggtgttcacctttagttccgactatgattatagcctgctgaatgcgaaggaagtcattaagggtggaaccggatatgacattacgggcaggcttcccgaagctgtggaaaacagccggatgatggattatttcatttacccccaatatcctttttcccttcagttcttttcaaggggctgcatccgtaaatgtcctttttgtctcgttcgtgaaaaggaaggatacattcagagcgtggaaccggtggaactgaatccgaaaggaaaatggattgaggtgctggacaataatttctttgccaatccgcagtgaaggtcggcggtggattatctgatgaagacccggcaacccgttaaactgcacggtgtggacgttaggattatgaacgaggaacaagcctggcatctgaatagaatgaagatgaaacagaacattcatatcgcgtgggatttgccccgactggatctgaccgaccgtctgaaagagatggtcaggcatgtgaaaccttacaagataacctgctacgtgctgataggattcaattcgaccgttgaacaggatttgttccggttgaacgtactgagggaactggggattactccctttgttatccctttccgggattatgcaaacaagcggacgcctacacagtacgagcgtgaccttgcccgatgggcgaaccggatgtggctgttcaagtccacctcctttgaagactatacaccccgcaagggtttcaagtgcggggaatacctgaaataaaccgataaggacagtaaagacaatgagaacaaaaggctactacgattcgggatgattcgcattccgcttccaagagagaattaacaagagtgtttcaccacaaaatcaagtaacgatgcgaataacatattatgactccggctgattccccaccggaacttaccccctgaatcaataaaccataagcggccacggctgccttatggggatagtgaaagagggcagtccgtggcttttttaattacttactgatttttcgcaagttcgggtgtctttgccaaattgcattttggttacgctgaaaccccgttttgtcgagtcagcgacaagaggatgtcaagtcagcgacaaggcaacgccgagtcagcgacaagacaaacaggcttggataacctcaaatgcacgcttgcgaaatatgaatcacctaaaaaaatcacggaaataaatgaaaaagaaaagattgattatgatgcttgccgctgttgcggcagtaagtgctgcaatggcccaaggaaacgggcaggcaggtataaccgaagcgacacaactcgtgacgggatatttcgaccccggcacaaaattgatttatgcaatcggtgcggtaatcggcctcgtcggcgggatcaaggtatatcagaagttcagttcgggcgaccccgatacttcaaaaacagccagtagttggttcggcgcctgcatcttcctgatagtcgctgccaccatcctgaggtcgttcttcctctaagattcatactgaagagagtaacttatggctgattttgagataaataaaggtgtgggccgtgaggttgaatttaagggtcttcgggcgcaatacctgtttattttcgctgccggtctgcttgccgtattcgtgatgttcgtcatcatgtatatggcaggcgtcggacagtggatctgcatcggtttcggggtatcggcggctacggtgctggtatggctgagcttcacgctgaaccgtaaatacggaagtcacggactgatgaagctgttcgcggcccggaggcatccccggagaatcctctcacgaaaacgtatcacacgtctgattaacaaacaacaatcgtaaattatgagaagtatattaaaagcatccacactggaaagcaagttccccatcatggcggtggaacacggctgcatcgtcagcaaggacgccgacatcacggtcgctttccgggtcacactgccggaagtgttttcggtatcctccgcagagtatgaggcgatgcacgccacatgagcaaaggcaatcaaggtgttgccgaactattcaatcctgcacaaacaggatattttcatcaccgagaaatacgagccggacatccgaaaggacgaactcagcttcctctcccgcagttttgaacgccatttcaacgagcgtccctacctgcaccacacctgctacctgttccttaccaagaccaccagggaacgctcccggcagcaaagcaactggaacatgctctgccgtggttttctggtgccgaaggaaatcagggacaaggaaacggtggaacgcttcatggaagcggtagaacagtttgaaagtatcgttaatgatagcggccttatcaggctggaacggctcaccacggaagagattacgggaacggaaagcgaaccgggcattatcgaaagatacctcacgctctcggctgacgggactaccatgttgcaggatatgcaactgaacccggacgagatgcgtatcggtgacaagcggctctgcctgcatacgctctccgacctcgacgacctgccgggaagggtaaggacggacggtcggtacgaacgcctctcgacagaccggtcggactgtcgtcttagctatgccgcccccgtgggcgtgatgctgtcctgcgaccatatctacaaccagtggatattcatagacgacagtggcgagaacctttcccgtttcgagaagatggcaaagaacatgcagtcgctttcccggtatagccgtagcaaccagataaacaaggagtggctggacgaatacctgaatgaagcgcacagcaacggactgcaatccgtgcgctgccattgcaacatcatcgcatgggcggaaaacggggaggaactccgcagggtgaagaacgatgtgggaagcgcactggcattgatggaatgcaccccgcaccacaacacgaccgaccttccggctctatattgggcgggcataccgggaaacgaggcggacttcccggccgaagagacgttctacacgttcatccctcaggcgctctgcttcttcacggcagaaacgtgttaccgcaactcgctctctcccttcggcatccgcatggtggacaggctgacgggaaagcccgtcttccttgacatatcggacttgcccatgaaaaaagggatagtgaccaatagaaataaattcatactcggccccagcggtagcggaaagagtttctttaccaaccatctcgtgcgccagtactgggaacaggggacgcatatcctgctggtggataccggaaattcgtacaagggactctgtgacctgataaacttgaagaccggaggggacgacgggatttgttttacctacaaggaagatgatccgatttctttcaatccgtttttcaccgaggattaccagtatgacatcgagaagcgggacagtatcaaaacactgatactcaccctttggaaaagggaggacgaaccgccccgacgctcggaagaggtggcgctgtcgaacgttgtcagtctgtatatcgagaagataaagaagaaccgggagataaagccgaacttcaattcgttctatgactttgtaaagaaggactaccgcaaggtgttggcggacaagaacgtgagggagaaggactttgacgtggacggttttctgaacgtgctggaaccttattacaagaacggtgaatacggctatctgctgaactcggacaaggaactggatttactgaacaaacggtttatcgtattcgagttggatgtcgtgaaggataatccgatcctttttcccgtcgtcacgattatcattatggagacatttataaataaaatgagacgtttgcagggtatccgcaagatgatattgattgaggaagcttggaaggcaatcgccaaagaaggtatggcttcttatattaaatatctctttaagacagtcagaaagttttacggagaggcggttgtcgtaacgcaggaagtggatgatataatctcttcccctgttgtgaaagagacgattatcaacaatagtgactgcaagatattgctcgaccagcggaagtatcagaacaaattcgaccagatacagaacctgctcgggctgacggacaaggaacgcagccagatactttcaatcaaccttgccaatgcagcgaaccgactttataaagaggtctggatagggcttggcggcacgcaaagcgcggtatatgcgacagaagtttcggctgaagaatatttgtgctacaccaccgaagagactgaaaaactggagcttacccgccttactgaaaagctgggtggaaacatcgagctggctatcaaacaacttgccgaaagcaaacggcaggagaaaaagtaaccattttaattcctgataagacaatgagtaagaaagatttattaagccaatgcagggaagcgctcggagacgctaccctgaccaatctggatttattaaacctgattggagagatgaaaaaagaactggaacacgaccgcatctgcggtcactgaatgaacaaggaaggcggctccacgctgactatccgcaaatccaaccgtgtgacggacggcttcaagggatacaaggccacgctgtttgccggagaaaagagctataccgaaatcaacattccgcttcgtaggggtgacgacctgttccttcacggaaataaggatgccggatatatcgggtatttcagcggtagcgaggttctgctcttcggcagttacgggctgtttgcccgtgatgacgacagccggtatttactaaccaaagaaaggagatagacgcatgaaaaagagaataacaatcctatttctggcattgctgtccctttcagtgacaagtaaagcgcagtggacggtgttcgacccgtccaaccttgcccaaagcattgtgaactccgcaaaggaaatcgtacagacatcctcgactgcacagaatatgttgaacaactttcaggagactgtaaagatttaccagcagggaaaagcctactacgacgcactcaaatcggtacatgaccttgtgaaaggtgcccggaaagttcaacagactatccttctggtaggtgacatcagcgatatttacgtgacccatttcaataccatgatgggcgaccctaacttcaccgtggaggaactctcggccatcgctttcgggtataaccggttgctcgaagaaagcagcaacctgctgctggatttgaaggaagtaactacagctaccggactttcgatgacggacaaggaacggctggacatcatcaaccggatatacggcgaagtgttggaatacaagaacctgacatggtactatacccgcaagaatatcggcatatcgtacctgcgcagcaagaagaagggagactctcaaagggtacttgccctgtacgggacacaagaccagcgttactggtaatcattcatcactaaaggaataacaaaactatggtattactatcaatagactggacgaacctgcatgagttgctgcgttcactttacgatgaaatgatgcccctgtgcgaggatatggcaagcgtggcaaaaggcgtggccggtatcggtgccttgttctacgtggcctaccgggtgtggcagtcgcttgcgagggcggaagagatagacgtgttcccccttttccggccattcgtgctggggctttgcatcatgttcttccccactatggtattgggcacgatcaacggaatactttctcccgtgtgcagcgctacttcctcactggtggaacggcagacctttgacatgaagaagtatcaggaagaaaaggacgaactggaacgggaagcgatgcttcgtgacccggcaaaggcctttctggttagcgatgaggaatttgacaagaggatagacgaactgggctggtctttgggagatatggatacgatgataaacatgtacgggcagaaggcggtgtatgacatgggagaaaaggtgcggcaatggttccgggaactgctggaactgttctttcaggcagcctcgctgctgattgacacgctgaggactttctttctgatcgtcttgtcgatactggggcctatctcctttgcactggctgtctatgacgggttccagagtacgctcaccacctggctgtcacgctacatctgtatttacttatggctacccgtgggcgacctgttcggggccatcctctcacgtatacagattctgatgttgcagcaggacatcaaacagatgcaagacccgacattcataccggacgcttcgaacagcgtttattgtatattcatgattatcggtatcatcggttatttctgcgtgcccacggtttcctcgtggattatccaagcaggcggtgccggagcttacggccagaaagcgaacagcgccggaaagatggccggtaacggcgcggcggcagtcggcggggcagtcggcggatcggtagccgggcgcatcaagaaaatgttttaacggacaattaattaacagaaaaaagatatggaatttaaatcattaaaaaacattgagacatcgttccggcagcttcggctgttcggaatggtattcctgggagtatgcgcactggtaacggtcttcgccacctgaaaggcatacgagtttgccgaggcgcaacggcagaaaatctacgtactggacagcggaaagtcgctgatgctggccctctcgcaggacgtgcagcagaaccgtcccgtggaagcaagggaacatatcagacgttttcacgaactcttcttctccttgtcacccgacaagagcgccattgaaagcaacatccagcgtgccctttacctttcggatgaaagcgccatcggttactaccggaacttgcaggagaaaggctacttcaaccggatgatagcgggaaatatctcgcagaccctgacggtggacagcatacggggaaacttcaacagttatccctaccagatgaagacctattgccggcagcacatcatccgttcgagcagcgttaccgaaaggtcgcttgtcacgacctgccgtctgagaaatgtaacccggagcgacaacaatccgcagggcttcctgatagagagttttacaatcattgaaaacagggacatcggacagtatgaaagataacgggatgaaaaaggtcttccactcgttcagaacgaagaaagaccgctgtatggtaaaactccgcagacgctggcggcgattgagctaccggcagcaaaggatgatcatcctttacctgctcggccttttcgccgccatcaaccttgcctacatcgtgggcggattttgcgggaaagacaaatttccgattgaggtacaacacatccaaaggattgtgcttccccaaacggacagtatccaaccattcaaaaacaatatatccaatggcacaatcagataagaaagaagaaaaagagaaagaacgggaatcacagaaggcgaaatccgctttagaaaaggaaaagaagcagggcggcaaggccgttgaaaaactcaaattctacggcgtggtggcattcctctccctgctttgtgccgggttcatctggtttatcttcaaaccggacgcgcccgaaacggtggaagggatggcgggtatcaatacgacgatacccgacgctatcgcacccgagacgatggccgacaaacagaaggcctatgaactggaagagatgaagaaacgccgcaaggaaaaggtaagaaccttgcaggacatggcgggggactatctgacaccggacacgctcgatgggctgaagccggaagaaagagcgccgagggtggatgcaatccgcgagtccagggagaagcagcgacagatttcacgccagattacctccttttatcaggagccgaaggaaagtcccagggtgagcgaactggaacggcaggtgaaagaacttagcgaaaagctggaacgtgaacgcaagtcacaagacccgctggaactgatggagaaatcgtatgaaatggcggcacgctacttccccggacagacgggcggacaggtgaaaagcatacagactgccggtggaacgggggcgggcaatcctgccgcaatagccgccggacgtgtcaccgaaaacgtagtatcgtcactggctgcgccaccattgccggattcaataccccgtaattacggttttgccacggccgtaggcggcgggcagtttgccggagccaatacgatacgtgcctgcgtggcggaagaccagacggtgactaccggatcacgtatcaagttccggctgttggaaccgctgcaagtgggcagtgtactcgtccccgcaaacactccgctattcggcacggtgcgtatcgagggacagcggatggcggttagcgtgaactccatcgaaagcggcggcaatatcctgccggtggaactggcggcttacgacatggatggacaggccggacttttcgtcccgaataccgcggagcgtaccgccatgaaggaagccgccgccaacatcggaagcggtttcgggacaagcatctcgtttgcccgcagtgcctcgcagcaactcgtcatggacgtgacaaggggtgtacttagcggcggctcacaatacctggccacaaagatgcgggaagtgaaagtgtccgtcaaagcgaattatcaacttttattaatatcccaaaaacagtaatcagattatgaagacaagaattattttatcaatagtcatgcttttctctctgctgggtgtaaaagcgcaggaaccggtggaaacaaagattttccccaccaatcagattatcgcaccgcataagattgaggtgactttccagaagaccgtgcatatccttttcccctcggaagtgaaatacgtggatttaggctcgttcgacatcattgcggacaaggccacgggagcggaaaacgtagtccgcatcaaggcggcggtaaaaggatttgagggggaaacgaatttttcagtcatcaccgccgacggttgtttctattcttttaatgtggtctataaggacgagccggcacagctttccatcgagatggaagactggctccgggacaatcccgaaggcggttttgccggcgaccgcatgttcgtgaagctgaaagaactgggcggggagacaccgctggtggtgaaccgcatcatgtacacgctatataagaagaacaaaaaggacatcaggcacatcggctgcaagaagtacgggattcagacattgctcaaagggctttatatcaacaatgacctgctgtatctgcatacttccgtgcgcaacacctcggacatatcgttcgacatcgactacatccgctttaaaatcatcgacaagaaggtggccaagcgcacggccatgcaggagaacttcatagaaccggtaaggacatacaaccgtctgagaacggtggacgggaaagctacggtacgtaacatattcgtgttgccaaaacttaccttgccggatgacaagctgctcgtcgtggaggtttacgaaaagggcggtgcccgtcaccagtcattccgcatagagaataccgaccttgtggcggcaaaaccaatcagtgagttgcacctgaaataataacctccatataatataatgtatatgcaaagaatactattcatattggcattagccgtggcgttgttcttcacagcggacaaggcatacgcgcagcgtgacctgccgggacaaacgggtgtacagtttacgacaggtggagtcgaccgtttcctttcgtggaagagtggcggtgagcgtcactacttcacctcgctggcctttacacgtaccaaccgtaaccgtacctactggctgtacggcctggattatcagataaaggaatacacgtatgaaagtaaggcgatacccaaagcgcagtttacgggggaactcggttacttcattcccgtagtatcgaacaagggccggaacgtatgcttccgtatcgggctttccgcgctgggtggttttgagacagtcaactggggaacctccctgcttcctgacggggcgtcagtgacgaacggggacagctttatctatggcggcggcctgacggcggctttcgacgtctggctgacagaccagattatcctgctgatgcaggtaaaggaaagggcgctcttcggaacggatgcggggaacttccatacgcagataggattgggcgttcgccttattattaactaataaaaagtgaaaggagaaacagaaaaatgaaaaacgtattatatatatgtataggcgcactaattacagtgctggccttgagttcatgtaacgatgcgatagacatccggcaggattatgatttcaagctctcttcttggtatctgcaaaaacagattacaacgggtgaaacggtggagatacgcttttatcttgaccgtgaaggggactatgagaaggcggagtatggactcggatatatacaagtggaaggtaagggtgaagtattcgacagcgaaggcgtgaaacttatcaaccgggaagtaaggccgctggcggaggtgccggggctggatacggaaaatccggtgaagcaggtattcacactcttttaccgttcgacaagcgccaaacgctcggaactgaaattctttgtccgtgataatttcggacgggaaagggaactgacggtaacctttgatacggaaaacagtacggcggaagaatagccgttaccaaaattcacaaggaaagacggcggggcaacctgtcgtcccctattttatgaaatttgcttaatgaaaacaaatgaataagtaattgttccggattgcacaaaatttgtttctatatttagccggaagttaattaatcaatcagatacacatgaaaacaacactcaggatattccgcattgtactcaagttgctcctgctctcttacgtggcagtggtaaacattatcctcatatcggccttttatgtcctgctgctggcaatcgtcggctgggtggccccttcattcctgccggggttgttcgcccaatactcctttgcgcatcatctggtctattcgttgcctttttatatcgtattgctttatatcctctacagcctttcgccgctgaacgtatgggtgatgcggatgaaagaggggtacaaaccgctggatgccaatgaacgggcacggctggaacgcctgctcctggaaatggggatggaaaggaagctgaacatttaccgtaacagggacgcacgcacgaacgccgtgactttcggcttcaacactatcggtttgacgggcggcatactcggtgcggcctcggatgaggaactcaaagggatcatctgccacgaagtgggacatatatcgcattatgatttcgtctatcaggtgcttcttttctcgatgcagtcgctgggctaccgttgtctgtacgggctgttccttattccttccctgattttcggggtgattgggaactttatgatcggtgtggtgcctgccgtccgttttgccgtggggggaatagcgaaattgtggtggagtgcctacaagttgttgcaccacacgatttacggtctcagccggatagccgacgtgaatatcaacaaatacgccgaataccgttgcgacacgtatgcggtgcgctacggttgcggagagggcctgctctcgttcctgcgacggttggcggtggcggagacgggcggggagcggacttcgttcaccgaatatattatgagtacgcatccgtcaacagaaaaacggatagcccggctggaaaaactgctataacctgcggcaaagaataggtgcctatatcattttccggatattggtatagggaatgcccaatgcacgcacctgctcgatttcatccgaagtgtcttcatagtaacagacgatgtgactgcttgtaagcacttcttgaagactgtctttttctgaaagcgtttctctgttgcccgcctgtttgagcaaatcgtcgtataaggcgcaataaagcttgtcggcgccggccggataaggtgtttcgggtatgactgccgaaagaatgatgtccgggcatttgtccgcgtcgcgcaacatgactatcgtatcggccgccaacagcccgatataagtattcaggtggcaggagaatgtgcggtatccttcatcatacagtgaaagaatgcgccggtagagttccatgcggattttatcttctctgaattggtcgtattttgttgtcttttcaatggtactgccggttatggcaatgttcttattatacatcttgctatggtttattgattagtaccttgtccgtaacttcctgctaggtaccgaaaaaagcacggtacttaacaagttttactctcaggtacgaccaagcacccatgcaggaaacgagttaagaccgtgccataagcgtatgacaaggacttcgcccgtttattctcctgcattaaaattggtcgttttgagagtagaataaacagctaaaagctattatactatgtaatcattcaactttttttgtcttctaactatctttttaaaattcaactgcacaaaaatagaaaaaagccgggcaaccgcattatgattgcccgacttttttaagatgtcttttgcaggtgtggggtgtggcaggtcagtccacgggttcgccgccatatcttaggcggcagatgtcttcatggatttcccgcatgatgttcagttgcatccgcctgctgatatggcggcttggcgaacgcatgaacaaccggttctctatcaggctgcaaaacttggtgccttctttacttaccatgcaaatgatttgattttcaaggaaaaattccctatcggtggaatattcaacgttcggggatattctgatgtatttcatacattgacggtgtgaaaggtgattacggtggcggtgtgggtggggtcgtccgaccctgccctgccgcatgggtgggaaaaacgtgccggaattgtctccggcacgcctgctgtttttaagcggcttttccgctatcaagtttctccgctttcggggaggtgactttcttttccgtcttttcggctgccgttgtcggttgttgtcccgcttctttggctgccgccttttccgctttcctcatttcctttatcctctcgtccaaacgttcgtgacgtttctgatattcttcctcgtgggtggctttggcaagtccgtactggtcggggaagtgcatgtttgcgaagtccctcaacagtttggatgcgctgttgtctccgtaagcgtcctcgcaaagaaaatgactgatgaagtcccgtttgatgaccgttctttgtgcgtccgtcaacttggctacaatcttcatgcgttgtttttcgtccagcggcaacggctggtctttgatgccgcaaagcggataatgctttctttgcagtctggtcagcatgatgaaatacatcatcccgtcctcgtactgcgtgaaagggctttcgggatagtcgttttcacgaactactttctttgtatcggctacaatcttctctacggacaactgtttgaaacgcttgtccttttcctgcaatgtttcgatggtgacgggggcggtttctttcttgtttatctcaacatagcaaagttcgggttctctctgccctacctttacataggtctttatcctgccttcttcctgcttgcggttgagttcctccacttttagggtgtagtccgtctgtttcttttcaaacgtctttacggcttcttcatactctttcgggttggtgaatttttcctgctgcggtacttcgggggctttggggaaattctgtgccgaaacggtgtaattcagttcttttatctcgtgccctttcttgtcgagtttttgaagtgccgtttcgttcatgccaccgtaatagggtcgggctatcaccaatttcggatcggatttcaacagtttctccgtctcctttgccacgaatgcggcattcttggcttccaaacacttgcggttggtgcaatgtccgcacccgttatgttcggcaaaaaggttgtagttcgctgcgttgtgtacacattccctgcattccgtcttgtcgaacttgtattgtgcaaggtcggtggtatagtatttctcaaaatgctttttaaagaggttcaatgtatatcccgtccaattgtctccgctgccctctttgaggtgcttctcgtaaacgtccttttggatgtgcggttcataggtgcttatttcctcggctacgctgatggtgattgtttcattgtccaacagttcaccgataggctgatacagttcgttcagttttaggcgggtatagatatatttctcgctccgtccgaaacggctgacgagtgaatacatatcgtaccgtcctttttcaagcaagcgtttgaacgctctcgcttcttcggtggggcgtacctgctcacgctgcaaattttcactcagtgacatatcttccgcttcatcatccgtgatgttgccgtatatggttgcctttatcgtctttgctcctgcaagcaatgaggcacggtaacggcgttcaccgtaaatgatttcgtagcctcctgccgtgcgtgggcgtactgcgatagcctgcaaaacgcctacttcccggatactgtccgcaagttcctgcaaagatgcgtcattgaatgtcttgcggtggttctctgcgcttggctgcacggtggttatgtcaaggtcggtttcggctgtagccgttgcaagcggggttttaaactcggctggctgcggtgcttcttcagtggcggcaggcacattcggcccaccgattaacatcatcggcttttggatgactgccaaagcggttacttttacttctgctgtcgctttctctgatttttgtacaacgttgttcttctgtacttttttgctcgttttcataatgataaattttaaaatgttgataattaattaaataactttccgtctgaaaggtattcccaattgtgggcgttacattcctctacaaagtattccatcgtttgggtgctttccatatcatcccggcaggcacggaaaaaactgcgaagacaagcatttataagattgtcaaacgtaacgttctctgacggggattttagaaagtcatacatcggggcaagaatatagttgtctatgtaatatcccgtaagggggcaacaagtatctataaagattctgctctttcttcctttcgtccctttccaaaaatatttgggggcgtataggtcgctccaatggttgttcgtcagataggttgccagccgccagccgtttaacctgtctatgcagtcttcctgtctgctccgatagtcatagctataattgtatgcgtcatatctccaattgcggcacacaatgccgaagcgttcgcaaaaggtatcaagggtctgtcggttctcacccgtccagccgtaaaagtatcggttgcataactattcgatgtgcgccttttctttggcttcttcggataactcggttatctgataaagggtatatgttcttgtttctgttctcatatcgttatatgtgtttagaagtttttagatagcggggcggattgctccgccctgctgtgggtgttcttatgcttggatgcacgctgcaagtgcttcccttactttcgtctcctgcttcttgctgtatatccaccctgcacgcctttcaccgttataggtgaggttcgcacggaaaagaccgttcaagcctttgagaacgtcctttatcggcttggtatcaccgaatacggctatcgccttttcactgtactctacgatttcaaggttaagtgcagaaaggtctgcggatactgtcggctgttcggccgtgtctgtcgggggctgcgttgttttcagacaaatgttcgcttcatcccctgccgtatgcgcataccgttccaagagtttttcaaggctgtaaatcggttctttactaatcgtccaaccgttgtacttgttcctgcccaaatacataccgtctcccatgctgtaattttcacggtgttcgtagtctgcgttatattcggccaaatgggctgttccctcaaaattggccgcatacttgcgcatttctgaaaagaggttgcgtgtatgtttggaaaagcccaaaatcacggttctttctatacggtagttgtaatagtccgtataactgtcgcattcgcttacccgtagttcaccgataataacggcttttgcgtccgatgggatgagggggagcaaccgtgccgcaccgattttcgagatacgttcgtgttcctcccgtgcttcctttgctttgcgttcttcttcggctttcttctctttcgccttggcaagcaaagcggctgtttccaacggatctaaaaatgtcgggttctcgctgtcgtaatagatgcctattccgaacttttcggataacgggcggataaggtcggatgtgctgaagtcgtacgtacttgtgtgtacgagatgataagtaaatccgtatcggtcacgggtgatgtcatagactacataactgccgcctgcataaccttccaacacgacaatctgattgatagaaacggtctgtacgtctctatcgtagcttctgttagctcctaataaatgtactttagccataatggtttgattttaaatgaattaatatttagttagagtatcacgcaaataagaatgagcaaaagcgcatacacgcaaagggaaaggaatgtccaaaggatgcgccacacggtacggataaggaggaccaccactgccaaaacggccaacgtgggcagcaaaccacccaaaccaacggcaacacccccaataaaggcacacacgaaacgcaccgccacatacgccacgaagccgaccgccaaccatttcaccaattttttaatgccggttggagcggagccgaagcctcgtttcaaatcttgctgtatttcagttctctttttcataacattgactttttttttatgccttgtcggtggcttcaccttgctcgtttcagggggcagatacggacggggagaaaatatgcaaggcttttggtgaaaaattttcaaccgccccactggacggattgaaaaattttcgccaaaacccgtagggcgcgaagcgggcttgcagatttttaggggccccggccgtagcttcgcaccctgaactacggcaaggtgaagtcatgacaaggttataaaaaaggggaaatggctatagtggggaaaagagaactgaaatacggcaagattcggaaggctgtgccgaccggattatttatatgattataatcgggttttatatcggggaaaaagaaatggatgtttatatccataaaaaaagtgcctctatcttttggggatagcgcacttcttcagttgtgtgtcttcaaataataggtcctcacggattttctgattttatatttaatgcctattgaattaatataactattacaaaatcaagctggaacaaaagtaaatgttgtaaatggcaataaaaagtaacacaaataacaggatgaagcatttatcattcattaacgatttacataaggtgatgctacgcaggtattacaaatatttgttttccagtatcattaactgtagttgaatgattgcattaaagatgtaatagcaaacatcgttgggaatacaaaaaagaaaataaggataatatcttaatcaaagaactttagtttgtagtaaaatcgtaatatggttttactacatttgccacattgacaatcagatacatagaattatgaaaagtagattatggttatttgcctgcttgttattaacggcagggactgtgtttcgtggatgccatgtaccccagaaagagaaacttccccttgtacacgcacatagaggcggtgcggcactttatcccgaaaatacgatacttgcaatgacacatgctgtggcaacgggagttccggtcatggaactggatttgcatgtgacgaaagacagtatggtagtagtatcacatgatgcctatttgaaccatgttaaaacactgacacccgaaggggaaccgattccggccggcaaggacaaggattataagatctatgcaatgacctatgacagcctgcggcggtatgatgtgggcagccttccgaatccggcttatccgcggcggaagaatgtgaaatgctgcgtgccccgggttacggatttgattgacagcgtggaacttttgacggaaagcaatggcatcgctccggtgggctataatatagagataaagtccgatccgttaaaggacagcatttattccccggattaccggacgtttgccgacttgcgcatgaaagtgctgttgagcaagaagctgggtgaccgattgctggtgcaatgctttgacgcgcgtacattgaactatctgcatgaaaaatatccggatgtccgtttgtcctatctggtggaggataaaaacaccaccttcgaggaactaatgtcgcgtttggactttgtgccgcaggtctatagcccgcagagcgacatgctgacggaggagattgccgtgaaagtccgtgcgaaagggatggagctcgccccgtggacggtggatgacaagccggaaacagggcggctgaaaaagttgggcgtggatgccatcataaccaaccgaccggacagcgtaatgcagtggttgggatatccgcagaataagaggaaagaataattaatgagcaacattatgaaaccaatcattattgtatttttcagaccctgcaaacagcttttcttgtcgggcatgtgcctgcttctttccgtattcaccggctgttccaatgacaaagaagacctgccgcctgctcccgtttcttacaccgccctgatatatatgatagccgataattcaatggattcggatgtggactacagcatcagtcagcttaaagccggggcaaggcacagcgcaggaacagccgtagtctatgtggaccgcttgaacgaagctccgcgcttgttcaagattacccaggcgggcgaggaagtgccgctgaaaagctatgcagaagacaactctgccaatattgaaacactggtggaagtgatagaagaaacgaagaaacttgtgccctcggagaaattcgggctggtgttatggtctcactccatgggatggctcccgaacggatattcttccggtttgcgcatgacgcgcggcaaggcggagcaggactttccacgcacacggtatatcgggccggactttcatccgggcgatgtccctacttccgataacatgatagaagtggatgaactggctgaaagtttgcccgaccatgtagccgaatatatctggttcgatgtctgtctgatgggctgcgtggaaggtctgtatgcggtgcggaacaaatgcaattacctgatagcctcgcctacggaggtgctggcggaagccgactatgacgcgtcgggcattccctatgctaaagtactcccttacatgtttggcggtgcagaggaattgaaacaggcttgccgggcatactacaaccactataacggcatgaaatatgacgtgctgcgttcggctaccataactttggtggatgccaagcaactggacgggctatatgacgtcgtacatgggatactgggcggtcatttatcagaggtggaaagcatggacacaagcgggttgcaggcgtatcatacaaaggacgtgccgggggtgtttttcgacctgaaagatatggtgaatcgcttgaagagtacggatgatgccatattggaggcccaattagaaaagacagttgtttatacagaagctacggtttcgtttaagaatgtggctattgacagaaatagatattgcggactgagcgtttatgttcctctgagaaagtgggaaaagaatgcggagtataaatattactttgaaagtttagaatggggaagaatatacgattaagaaacctccgggaccgttgtgttatgacaagctgcaaaagcagatgcacgtgagcaggctgtagtaatacccggccagtttgagctggaagcgtaaatccttcattatgatagataccttcttgtaaatgctttcaatgctgatattgaactggctggcggttcgttgggcaggatagtccaattctttctgacagatgaaaacctgtttgtccagttcgggatatttattgagtaccttctctgttatcttgcgaatctccccggcacaatagtcggattcgggtgatgaagaggatgaatcattgtcgggtagattgagaaaatcatccagcgggctttctttactacacttgggagaacggtagtaatcgactacacgtttcgttgccatattgaagaaaaggctttcagccgagtccatgttttcgtatatgagccgggatgcattttgccagatgtatagccagaagttctggcttaaatccaaggcggtatcagtatcgttcgttacattatcaaaataccgtaacagcttttgcccataccggtcataaagaattaaaaatgcttcagaatcggccgatgtggcgattgcctgtaacaatatccggtctgcctggagtttctttagttgatttgatacatttttattcatacttctttttaggattttgtgcctcaaaagtaaaaagaggttatttcagagttgtgacagtccattaaaaagatagataggtcgttaaaatttacatggctgtaatgtgcgtgaaacagaagtgtaatatttggcagggtaatcggccggaggacaggataatgtatataagtgatagctataaatcggaatataatgggaaagttaaaaagcagggataaatgcaggaaccttttagttttaactctttttaaaggaaggttttgagggtatcaaacgatttattagtgtaaaggttctcaaagtgatgcgggaacttgaatgtagaacaaataaaaaacagataattgatatgattaaattttggagaaacaggacgaaagtaacacctgaacaagaaaaacgcgtatggaaccatatagattccctctattcgaaacttgaagaaggaaatgctaccgaagatgaactcaagcagattgacggcatctccaaaataattatggatgttatcggcaagagtagcaaggtgaagaaagaaaagagattgcagttcttccatagtataaagtatgcgggagtaggagttgcagcaagcgttctattggtgatgggaatttcatactctgtgagtgaaaagcttgcggatagtacggatgccatggcatgcaatgtaatccaatgccggaatgacagtgtgcttcacctggcagacggcacggttgtttaccttgcaggcggcagtaatctgagcattgcgaataatttcggaaagaaagacagaacggtggccttgacaggagaagccttctttgaagtggcaaaggacaagaagaaatccttcatcgtaaagacgaaagagattaatgccattgtacacggaacctcgttcaatgtggtagcttacggcgggacagtggagagccaggttgcagtccgcactggatgtgtggaagtggcgaaaggggagcaatctttcggtaagttccactgtggcgaccgggtggtttatgataaggcagccaacagagtttcgcatgacacggtgaatcccgataatatcggagcatggactaccggtggtttcgtactggaggatgctacggtagaggagctgaaaataagggtgaagaaccgtttccaccgggaactggtgatagagaaggatgccatacctgcggacgcccgaatcaattattgctcgtataggctggaacaatccggagtaaataatgtgatgaaaaatatatgtgccatttacggtacgcgatatgaaatcagtgacaaccggattgttgtaagccggtaaccatatacatccacgcgccaccttacgaggactgcacgcgtaacgaaagaataaagaaagacaagcctgtggtatgcggtgacgagctgcatacgtgaaagagaaatttccctatgtaaagggaaacggccattgccttgtcttttcggaaatgaaaaatgaaagtttaactaattgaaaataagtgatttattaagtaaaatattaacgaattaaagatgaaaaggagtaataagaaaatgagattacgaacgggcatattgttcctactgggaatgttgctgctatcgtcggtctgccatgcgagtgacgaccaaaaggcaacgagctatccggcagaggcactggaactacggttgaaccgcatcgccaagacgtataaggtagaggttgcattcgacgggaagaatatgaaagccattagtgtgcctgctgcgaccaagcgcaattcagtagaggtggatttatccaacagtctttcaaacaccgattattcatataagaaagtatcagcggaatcatattccgtatatcaggacgataataaaaacaagaaaagttccggaaagggaactatcacgggaaccgtactggataaggacggatttccgataccgggagctacggtggtcattgctggcagcaacaccggtacggcaacggacattaagggaaacttcacactgaaagatgtgccggcacgtacctatatggtagaagtgagctgtatctcgtatcagaaaatgcgcatcagcgacgtgaaagtagcaggaggaagaaccactccgttggatgtaatcctgcaagatgagacagagatgctgaatgaagtggtggtaaccgctacctataacaaggcatctgccaatgcgctgtactccaagcaaaagacaatggttgctatgagtgacggtataagtgccgatcttgtgaagaaaaccagtgacaacaatatggcgcaagtgcttcgccgtgtgtccggtgtgacgattgataacggcaagtatgtaaatgtgcgtggtatgggcgaacgctataacaatgtgcagttgaacggtgcatccctgccaagtacggagccgaaccgcagaaactttgctttcgatgtgataccgagtggtttggtggataatgtgactattgcaaagacctttactcccgacctgccgggtgaatttatcggaggattgatagaagtacaaaccttggcggtaccgagtaagaagtttttcgatataagtctgggtacaggtatgaacacccagagtacgggaaaagacttcttgagcaacaagcgtttcaaatccgactggctgttcggtgaaatgaatgaccgccaatggtatgccggcagaagtgaagacgaaggtaaaataggcacgcagaatgctgcattgaaaaatactttcggaatgaagaaattcacagctatgccgatacagaactactctcttacctttggtgctcctatcgaattgggttacggacacaaactgggggtagtggctgctttgacctaccgtaatgaacagactacggaagaatataaagagatgaataccataactaaagacagtttgaacggaccgggtaaacgctataagtttttgacttctgtcggtgctgtggctaatatcggttgggaaattcagaatcataagattacctggcgaaacatgttcaacaaccgttttcaacatacgaatcttgaacgttacatttttaaatatactacagcgtttaatacctatgagcagtatagtgtccctttgcgcagccagctctggcaaacccaattggaaggcgagcatcggttgttcaacgaaaatctgatagcgacatggaatgcgtcttataatcaggttggtcgtaccaatccggatgaccgttacgcattgggaaatgttcaaggagatgtggaagatggcttggttgattggagcagtactgttaccagcagccagttcggacttgaagacggacacttgatgtatagtaacctgaaagagaagaagaaaagcattggcttaaatctggaacatccttttgtagtaaagggaaataagcaaaccatcaagaccggatatatgggaactttccggacctccaattatgaacagcaatatcttcatgctatgtttggcaacaaaggagaaggatgggacgcatggaaagaactacaggaatcacatccggaattgggagagttgtatgacccgaagaacttcgcaagtaaggcaatttattatgcaccttccggattatccggattaaatgaagccgattactacgaagggaaacaaaacatacatgcggcatatttgatgggcgaatttacgttcttccgtaaactgcacttaacggcaggtgtccgtatggaagatgccactactgaagtgcaaacaacaatcggagcggatagagttgatagtttggtttcggtaaagaaagccgactggttgcctgccgctactctggtgtataacatcacggataacatcaatgcccgctttgcctacagccgcaccatcgcacgtccggactttagagagcttaccccttgtaactattataatgtagacgaccgtatagaagtgaaaagccgtggaggcttgaagcaatcccattcggataatttcgacctccgtttggagtggtatccacaggcaggtgaagtagtttcggtaagtgctttttataagaaattcaaagatcctattgaaatggtgacgcgagagacgatggatttacgatatgtcctgcaccctttcaatatagatgatgccagcgtaaagggtattgagattaatcttcgcaagtcattggccttcattgctccgggttctttcttgaaggatgtgtatgtcagcggaaacgcaacttttctgagtggagacgttacatacaatcttgaacgattgcaaaacgctgcttccgggattgatagagaagttaaaacgcaagaccgcagtcgccccttgcagggattgtctccatatactgtgaatgccggattggcctatcagggaaaaatactcggtgcagcattgaattacgggcgtaatggacgtaaattgctgtttgccggagattacgaaaagtatgaccaatacgaagcatcgagagacgtacttgacttgcaaatctctgcccgtttcctgaaagaaaagttggaagtgaaattcaatgccagtgacctcttaaatcaggacgtgatagtgtaccgcaattgcggatatgaaccgggtgttgacccgaataacgataaaggatatgctgatttaacttcaaatatgaattataatagcggagattgggtgctaagccggataaaaaaaggtataaacctgtctctgtcagttggatataaattttgatttttcagtgtttatcagttttatttattaacttaaaaaagaaaagttatgaaaattaatttgaaaagccttgtaggtgttttaagtgtagcagctacagcagtgtcggttacttcatgtagccaaagtgaagagatgcttcccgtgggtaatacccgtgcagccaacgtggtaaccgtatccggtgttatcaataccaatatgacttggagtgcttcaaatgaatatcatttgaacggtaaggtttatgtgtctggtggcgctacattgactattcagccgggtacgaagattgtaggtctgtacaatgatgttccggcaaaagcttctgctttagttattacccgtaatggtaaaattaacgcagcaggtaccgcttccaatcccattgtgatgacagcagagtctaatcatcaatatcctggtggttggggtggtttcgttgtattgggtaatgctcctatcaaccaaactaacaatccagttattgaaggcattgaatcagatgaacttcctgccgatgtagatattcattatggtggtagcaatgctaacgataactccggtacgattcagtatgtacgtgttgaatatgccggtgctaacgtttcacaggacaatgaattaaattcatttactttcggtggagtaggtgcaggtacaacttttgaccactgtcaggcatactacggtgaagacgatgcattcgaatttttcggtggtacaattaatggtaaatatttggtatctaccagtactcatgatgatgcatttgacttcgactttggttacacaggtaaacttcagttcttggtagcaactgtagatgcaaatagtacttattatactaaagatcccaatggtatagaatgcgataacgacagtaaaggaacatctttaactccgttcactcacccgacaatcagtaacttgacaatagttggtaccgctgatggtaaggtagcaaagtctgcaatgtctgatggtaaatccatgaaatcttgtgctaacttccgtagaaattgtcagtttactttagcgaacagtattctttacggatatcctaccggtatcttgtgtgaaacatctaacagctatgttttcaaaaacaatgttgtaaatggtgtttcaacaaacttctctggaattactgctgatgctactaatactgctgctgcaagtgttgatgctattggtttgacttctccatggggtgcatataaaagccaaacaaatctgcgacctaatgctgctccggcactttctggtgccgattttggtggtttggattcttggtttactgttacttcttacaaaggtgcaattcccccgaccactggaggtgcaaactggatgatgcaaggaacttgggtgaaataataattaagtaaagttgagccgtgaatggattttaagtctgtttacggctctatttattgattggaaatgaagaaaaatatatatttaatattatttgtattttcactgctttttgtcagctgcgatactgaaggtgattttatagaacatggttataccaactatcgaataacagtcatgtatccggaccattttgctgactttaacaatctgtcggttactattgacggagaagatataaaagatggaatctttaagggaaaagaagaaagaataggtatattggcaatatcctatctggattatgtaccatttcagcaaaaggttaacttgcaaccgaatgaaacgttacaaatattattattacctggaaaagaaattgaactatatgaagaagaaaagtatatcacttttaatggtagttttatattgaatagtgggtatactgtaaaaataaacggtcaggaacttatacaaggtcttaattatattagtaaggaaaaagcagtgggaaatcttgaattttataaggaaggagaagatgaaccgatagctacgatatctgatatatctattgaagctgattccactctgaatttaatgcaattatctgatacggaatttatagaagtaccaaaagacgatgaacctgatccgctatccaataaaatattgaaagcacgttttctttatttgggcgatgacatgcttacaatggataaagttcaagtagacttttatatcaatgatgattggtgctggatgttcttccctgaacgtataggtactataacgttagaaaagggagaaatgtctgaatatatcgaattggattattcatttagagaacctgatgcttatggtagttgtactagtgaaggttatggatattcattctattatgatgttatagatcccgaaactaatatcacgatagtggaccacaattcttattcagcaattttgggtgctaatgatatgccaagtatagactatatgtcttggacatataagaaagctacatttattttgaaagatggcggcaatgcctgcgattttcagaaaggattaggtataccttggaattaataactttgttgaagccctctgacaaaaagcaatttcagacatgtgctaaatgtcagaggtgcttttcttgataatgaatattcactaattgaaaagtaagaataatgaaacacaccctaaaaggttggctggtagacaatgctgtcaccgtagacaacaaagaagataaaatcctgatgctggaatcagccggaagccttacgctggaggatatacttagcgcaatgaagaaagaagacacaggtcttcgtgaagaaaccattgagcacgcagtgaagctatatcaccgtgtgttgtcagacttgatactgagcggctattcggtgaataccggacttttccgagccgtaccccaattccgtggtgtagtagacggcggacagtgggatcaaaaaaagaattcaatctacgtctcctttacccaggacaaggacttgcgcgaagctattgcgcagacttcagtcaacatcttgggagagaaacgggacgccatgtatataataggtggcgaagatgccgccacccgtgccacgggcggcatggcaaccgccggacgcaactacaccctgaacggacgcttgataaaagtcgttggtgaacatgaatcggtaggtatcaccctgactgatgcttccggcaaggtcagcaagctgcctaatgatatgctggtggtgaacaacccctcgcaactcattatcttgcttccctccgatttaacggacggtcactacacgctgacggtcactacgcaatacagtggtacaaatacattgctgaaaactccgcgtagtacgagcaaagtgattaccatcgggcaaagtggtggttctgaaggtagaaataccagtgatggaaacttggatgagaatcctttaggataaagcctcttatccggcctttttagacagagctgtctaaggagattagatagggctatctaaagctcttcgataaagcggtttcagacatcaaaacaaatgctttctttcattgaataatttgaaataataaaagaatgatagacattatagcaaatatagcttctattctgggttttaccatgcagatgaatgataagttctttgcgcatggaatgaataaagagcaggcggacaatgaaatgctgctgttgtttctgaagcaattgtccgtcaaatccaaagcaataaaagagatacatcagaagtatcattcgttgagtaatgattttcgccttgtagctgttttcctgactaatcccgtcatctacgagaaaatagtgaccaaccggagccgggcattaaaaaatgcactgaaagaatccctgcaaacgccgtcggcacgtatcgctcaaacacaactttctgcccagttgcgtccctgctttgaaaatctgttggtgagcataaaggacgaatcccacttgtctgtggagttttccgggataaatgattgcgagatgaaagccatattgcggaaaatacttaatgcacagaaagaaatcttccagttgcaccaacaattctgtggaataatgaaaaccatcggcagttatcctctcggtaactggggcgacagtgagtttgactttatcaaaacgaaccaacgggtatttatctcggatttctatagcatcattgattatgcggatatcatcctgatgggatatttggatatctaccattgtgcattgaacctcaaataacggattgtatggaaaatggtattgaagaaatattgaaagaacatgaggcactgtgcagccgggtatttcatcttctgaatacaggtaatccgcaaactaaggatatagaacttatcatacctaaagtgaaagaactgttcggaatgctggaagccgtcaataccaaacaaatcactgcacagcaatataacggcttgctgaatgtgatgagtgaatggaacgctattttcagctatttcaatattaatatggttccgtgccgtttacggcctttcttatggaactctccaaaggtagctgtgaaaagaataccccggcaatgtatcgaggggatagtggtaagcacgaaaatgcaaaagacggctgtcatagaggtggaacgtacgaaaaagcatccgaagtatgggaaaacagtacaatatacgaaaaagtataaaatacatgatcccctggaggaatgtagtgtaggagaccgggtgcttgctcatgaaaccagacatttcagcaagactaaatattttagattttacagaaaactgtattgagacggtaaaaaaagagtaggtatttcagaattaatattggatatatcactatatggaaagcaaatgcattaacaattaaagactattgattatgagaagactaaccgtactgctgttccctgcttgtctattctcttgtcaaaacgatgataatgagaaagagacacgacctgaagagaaagaaagcgtattcaggtttattgataaagctaatatcacaaatacggacacttatgagaaggccgaattttgtttaagaatatactatccgaagggggactataccaaatttataaatgactttatatatgcggataatatccctgatactttggattacacagtgccggaactgtatgaaggatgtatctatgagtatcgtgtctttttgagtaacaaatcgtgggatgcacccaagaagtcaaaggaatatcgatttgcggaggtcagagtggagcattcatgtgattccgtgtattttgaatatcctaaggatacgataaatgcaattgaggcattggaaataagcagaccatgaaattttatgtgttaacaataataaaatgacatatatagtaacacgtaaggaatagaaaccaagaagaaaatccactgggataaccttttttaatgactttaaggcagagctgtctatcgtcattggagaaatagctctggccttgaaaaacaatcgctctttgacagaatgggacatatacggaaataaagataaccccttgaccgtttgtgtatttgcataaatagcattacctttgcagacaacaatagagaaaggaggcaataatggcaagaccgataaaagaaaccccgatactcttcggggaggatgcacggagatttgaagcgcggatgaaaaatccaccgaaagagactccggaaaagctggaagagataaaacgggattataagtacatcatgagcatttttaaagaagaaactgatggcagaaataaataatccagagtttggtgttcgccgtttggatgaacacgagagaatagaatcgttcgattgcggagacgcggatttgaacgattttattatgaatgaatctttcatttatagaaatgaactgcttgctgttagttatgtagtggaagatgcctttggcaaagttttggcatatttcagtctggcaaatgataaaatttctctttcggaatttgagaacaagacggaatttaatcgctttcggaaaaaacgctttgttaacgagaagcgtctgaaaagttatccagcagtgaaaatctgccgctttggggtagatgtttcgacacataatttgcacttgggcagcaaattgcttaatttcattaaaggctatttcgttattaacaataagaccggatgtaggttcattacagttgatgcctatattgatgcagtacctttctatctgaagaataattttttagagttgacatcaagtgatgaggatgcctctcatacaaggttattatattatgatttgaaaatgatggtttaaacgatcactcagacatattttttatttccgtcccgctaaccaaagtctttcgttggttagcgggacggtttcgttttgtcccactctgtctgaaatggatataattttaatcaataataaaaatgcttatggcaacaattagaaacaaagaaatcagtaaaacaggcggtgtatgcctgtcattcgtagctgtactggcaatagcggcagcaactttatttaccagtggaaaaccggttgaggagttatccgaaaatgccgctgtgggtcgtaaatcggtgattactgccgccggagccacattgccgttacctttctacagcgaggcgttcaagatgtactgggagaagaacgacatccctgttacttatgccggtatcggtacggaacgcggattcagaagcctgaagaatcaacagatagactttgcaggtgtggacgttccacctaccaaagcggaactggacagtctgccggtaaaatctatccttgtacctacgtgcatgggggcagtgactatcgcctataacctggaaggtgtggataacctgcgcctgacgggagagctgatagcagatatctatatgggtaagatattgaaatggaatgatgcaaggattgcggcagtgaactccggcaagcaattgcccgacaaggaaatctatcccgttttccgtctggacggtagcggaacaacttatatcttcagtgactacctgacgaaagtgagtacggactggaaggccaagattggcacgggaaaagccttgacctttccacgtggagtagcggctacgggaaatacgggcgtggccggactggtaggtaaagttccgggtgctatcggatacgtggcttcggaatatgcagccagcttcaatacgcagagtgcatggctgaaaaacgctgccggaaactttgtgcagcccacttcggaaagcgttaccgctgccgcaagcgtgggggatgctacgggcatgattaccgattcagaggttgccgacgcttatcctatcagttgcttcacatgggtggtactttataaggagcagaactatgctgggcgtagtcgcagtgaagcggaagaaatcgtgaagctgctggaatggctgatcagcccggaagctcagactatcactacccaggtgcaatgttcaccgctgccggaaaaggctgtggaatatgccaagaacatgttgaaggaggtgacatacgacggaaaagcattgagaaagtaatataagaatacgttcgtacttaacaaggagggacacagcgtgataacaaaaacaatgtccacatcggagaaaagaaaggggatgcagactgatatgccggaactgcaagccatgatatcacaacgaatccaagaacagaactaccgggaagtgctgaaaggagtgacagccttcccatggtgtacggatgatccgtgcgtctttcggaccgctgcgggtaacttgtggatagcggtagggcatgtgaaccggaaatcggaagtacccaagttcagttataagaacttcctctgcgcctatctgctgggtaatgcagaagatgaggtggctgcttatctggacttgcaggctgccgcttggaagggggtggaactggtgatgttctcctcccatgcggatggtctgtccgctttgtacggagatgggagagcgaatgaccgggatttgttgtaccgtttctttggacgaaactacgtttttgctgtcggcttccggcaaaaggaagagaaggagcaggcatcggctggtgataagatattcattgcctccgtggatgcggttggattcggggaaattgataaggacggcaaactggcggtcatcaataagataatgagctatgaacagttttttgatgacgaggacttgaaaccgatgtggggagcgcttgccgtgaaactgttcatcttgaaatgtaacggttatcgggaatcggccaaagaccggaaagcattggacattttgcttcatggcatgatgaaactgtgcaaatcaatggagttgattgccggattggatgaccagaaacggaaacatccggaaagtgccgggataaacccgcagatggctctgctgaagaatgaggcgatggtaaaggtgcataacggtatggatgaaaaggtaaaaagcaacttgccgctactggaatgggccgtcaatcacttaccggctaagttgcttcaggagtttggtacgttcgttgaatcggtgccccaaataaaggagcctacggcttacgataatctaatgtcgctggagagtgtgctgaaagaaatggaccgtctattcaaaaaggcagcggaggaagagaatttgtctttaactaaaaacagcatgacagatgggtaaacaagaaacgaaaccggataagaagcccatgcggatggtaacatccaagatgagcattgaagaaactattgaggtgcttcgcgaggatcttaagactaatgtacgttccaaagcatggagaaagcatatcctgctgaatccgaaggtggagggaatggccagattcccgtccggggttgattctgttttaatcaacactcctgtaatggaatggggagtgagattctatgttctcagcaagcaggaatggaagcagcagactatagatagatgcggccagttctattgcctggtaccatcgaatgccggtttccatgtttatctctttgtcacgatggatacgggtgagaatgctgtttttgttttccctccccatttttttatacgttaccgtgaacggtactggggaaaacacagtacgctgtccggaaagattttgagaaagacttatttgaaggataacctcgtgatgcgctacggcctgcaaccgggcagcgaggaacgggtggctggagcacggatatacggcgcatcctcccatggcgttgcgctggggattgtgttaaatgacgaagcgtatctcttcaagacattcatcacctacgcaatgacgaaaggggaacagataccgctgtacatgcaagagaatttgagcatggaaagggcgcaggtggagtattataataccggcaggctggctgacttggtggaactggaagaacgcgacagggaacgaagggaaatgctgatggccgaggaaaggcggcgtgaggaagaggaaaaacgtagagcggctgagccgggggaggcttacttctatgtggaggggccattgactcttataatgcctgacgaagaaatgcaggaagaaaataccggattctggcaacgaggaactaccatgttctgcgactccaaactgattgaagaatcgcaacgggagatgcgcgagctggcatcggttgaagcccggattcaggaactaaagaatataccccaaaaagcggaagagaaaaaaggcgtttttaaaagattgtttggccgttatttctgaacaatccttgttgattgacagagattggccagtgtaagtttaaactaaaaaagattgtgatgacaagagaagaaataatcttttgccggaaagcgcttgttgcttttctctttatggtggctgccatgtgtctgagtatgcttacgtcctgctccaatgaggacgagatgtttgacagggagactacagaggtactgccttcggtgtttagtgaggatagaacattgtacaccgatacggagtatctgattagtaagcctgtgtttgtgaccaacggcgccacgctgaccatacaacgcggcgcattgctgaaagctcttcccgcatcgggtcaagggaaagcggcgattgtcattacaaaggggtgtaagattgttgccaacggtacggaggatgctcctatcgtgatgacggcattgatcaaagaaccgggtagttgggacggtgtgattgtgttggggaaggctcctgtcagttatgagtatgagactttatattgtggaactgttgctacggatatttcttatggaggttctgaggggaatgatgattccggttccctacagtttgtccgggtggagtacgccggtgccgccggcggggcagtgacctttgacggtgtgggccggggaactacgatagaccattgtcaaagttactgtagcggtggcgacgggtttatgttcaacggagggacggtgaatgcccggtatctgattagtacgggtgccagccagaacggattgtgcttcaatgaaggatatacggggaaattgcagtatgtgatggctactgcacctattcggaagagtgtgtggagcgtggttagctgcaatgggacggggaaattggaagttccgtctttctatacacatccggtgattgcgaacctgtctacggcgcatgataataaatctcatggccgacggtatccgattgcggtttccgcatatagccggctgacactggtgaacagcagtacccgcgaggctgtggcagatgatgacattcctgtccaactgattggtggccaaccgggagcgttgccgggtatcgattatatcctgattaacgctacgcgtgaagtgagttccctgacccctgacaggtttgtgctggataccttttttgaacggacggattatgagggggccgtggctccggatgtgatgaaggacagggattggactaaggccggatgggtgaggcagggcaagaaaccatgaattacaaattaataaattatttaaaccataaatgattcaatacaacggaataaccttgctgcgggacgaggacagaaccccgatgcaagtaaacatcgacctgcgggtgcatggtacagaactggatgccttcatgcgtgcccacgggcttaccgcgcaggaacagagcgagatgctccgttcagtgacgggtgaggacatctctccgacttatgtggcgggtggaaaggtgcaacaacatgtgcgctatctgccggaaatgaaaagacaaatacagacagaaacggacaggctgttcgtaagcccgcgtacaaggcctgtgagtgtgataaggaaagagtttccggatttgctgctgcaccgcatcgtgcgtgtgctgacacccattccccggacgaaggcggcaacgccgaaagccttcgagcggtattgcggacgggacaccttctgggtgcggttcaagatgcagggcatgatgaacgtcacctggtgcgtattcttcacaatccatgacgagggaatcgtactggtgaggcaccttgccggagcaggagaaaacgatgaagacttatgaactgccggatagtcatagcggtgttgtccgtctgtatcttcttgagctttttcgttacccttgtatgcataggggcagtgcacagggcagaaaagcgtatgaggacgaggaatagaacaaaacggttgggagaatgggattgaaacttaaaatattcataggttatgccatgctgatacttctgttgggattcattatttacctgttccgcggggagcgtatgaaacgggatgaactgaagtgggaaatgaaagaactgggcataatacgcgaccttacgcgcaaaacttacggtcatctgctggaactggcgtcgcaaggcgaagtggtgagcacctggagcgaaagcgacttacggctataccgtgagagaagagaaaagacgtgcggtgtcctgaaggaactgcagcagtttgtacatacgccggaacagcaggaacgcatagactcgctgtgcctgctgcttgagcagaaagagatgctcctgtcagcggccatgagcacgtttgacgaactggaaaacatcggcgagacggtgggcgaaaaagtgccggctatcgtcaggcaggtgcgcaggcagccgacaaggaatatcctcgcccctgccgtgaaggaagcttatgccgggacagcaaccaccggggaagaacagccggagaagaagaaaagttttctgaagaaagttttcggcggaaaagagaaaaaatccgcttaccgacaacaacgggagcagcaacgggcggcatcggaaaaagtgccgtcgtccaccactcgaaacagcgggaacaatgccgctgtccatcttctccatgcgttgagccgcgaagtgactgaaaagcagaaggaacagcgggaaaagctgtcggcccagatggacagcctgcacttgagtagccgggcgctgaacaagaggctgaacgggctggtcggtgattttgacaaggtggcgggtgagcggttggaaacgagatacaatgccattgcggcagaccgggagaaatcgtacaatacggcggcgacgcttgcccttttcgtattcctgcttgccatcgtgctatataccctgctgcaccgcgacgtgaacaggtgtctccggtaccgcagggaactggaatcttccgacctgaaaaacaaggaactgctgcaatccagaaaaaacatgatgctgaccattgcccatgacctgcgtgcgccgctgacagccatcaaagggtatgcagagctgttgcccggagaagtggacgaaaagcggaaggatgagtatgcggtgcatatcgtccgctcgtccgactatatgataggactcgtgaactccttgattgaattttatctgctggatgcaggcaaggggaaaatgaacgtgacggttttccgtccgctgtcacttttcgatgagatagtgaagctgcatacaccgtcggtcagaaaggaagggcttacactctgtacggattttgagggacttgacaccgtggtggaaggagaccgcccgcgtatcatgcagatagccaacaacctgctttccaacgccataaaattcacccggaaggggaaaatcagtctgcaggcggcatacgggcagggagagctgcgcttcagcgtgcaggacaccggaccgggcatgacggaggatgaacagaagaggatatttagggccttcgagcgtctggacaatgcaaggtacctgcccggcttcggccttgggctagccattgtctcccgtctgacggaactgctgggcgggcgcatcacggtggagagcccttacgggacgggcagcctgtttagggtggccctccccctgtcggaagtggcgaagcatggggaggatggagaaaacgggtatgcggaggactacggactggaaggaacatacgtgctggttatagatgatgaccggatacaactggatataacccgcaggatgcttgtgcggaacaaggtgcggtgcgaatgctgccggacggtgcgggaactgatggcggcactgagggaaagaacatacgacctgcttctgtcggacatacagatgccggacatggacggttacaggatacttgatctgctgcgttcctcgaacatggagaacgcgcgtacgatacccgtgctggcagttacggcctgcgccgacgatgaagaacattatatttccttcgggtttgcgggctgcctgcggaagccgttctcgatggacgaactgataagcgccgtaagccgtatggtggtaaaaacggggaagaaagaacccgatttctcgttcatcctttcgggggaaaaggacaagggaaggatgctggatatttttatacgggaaacggaagagagcatccatacactggaaaatgcgctttgcgggcatgacagggatacgatacacaaggtgctgcacaagaaccttcccttatgggaaacggtgcggatgaactttccgatggcccgcctgcgcggtctggtgacacacacggcggctgtgtgggaggaaaggcaatatatggaagtcggggagataatccatgcagcggaaaagctggcggagtcggcaagaaaaatcagggagagtatagatgaagagcatactgattatagaggatgacatcgttttcagccgtaccataagcaattggctggtgaaacagggcatgaagacacagtgcgtggcgaccatagcggaggcgcgcagggcgattgcggggaagccgttcagtctgatactggccgacatgcgtctgccggatgacaacagcctgtccctactggaatggatgagggaaaggcggtgcacggtcccggtcatcatcatgaccaactacggggaagtggagaatgcggtgacagctattaagctgggtgccacggactatctgcgcaaacccgtgcagcctgacatcctgctagagcttatcgtcggaataaaggagggagacagcggcaagccgtccttctaccgtggcgaaagcgcgaaggctcaggagatgtacaggcagatagaactgatagcgtgcgccgacatttcggtattgctgcggggggcgtcgggcacggggaaggaacatgtggcgcacgagatacatgaacgaagccacagatggaacaagccgtatgttcccgttgattgcgggacggttccggaagagctggcggcatcggagttcttcggacatctgaagggggcgtttacgggtgcggagagcgacaaggcgggactgtttcggacggctgacgggggtacgctgtttctggacgaaataggaaacctctcgtaccggacacaagtgatgctgctgagggcgttgcaagaaaaacggtataggccgctgggggacacgagggagtacccgtttgacatacggctggtggccgccacgaatgagaatcttgagaaggccattgcagagggacgtttcagggaggatttatttcaccggctgaatgaatttaccatacgcctgccgttgttggcggaatgcagggaggacatactgccgcttgcggacttctttcttgaagaggccaatgccgagctgggcaaaaggacaggtggtttcgacagggaggcccggagcaggctggctgcctatcagtggccggggaatatgagggagatgaagaatacggtaaggggtgccgtactgcttacgcccgacggagaacggatagccgctggaagtctggctttttccgttcgggaagcggacggggcggatgcgtcagagacgcttgcgctgaatgatgcgcaaaaagagaaggaatgcatcatgcgggcattggaagagaccggaggcaaccgtaaggaggcggcaaggctgctgggaatatcaaggagcacactttatgagaaattacggaagtacggctttcaataaccgcgtgtccggcttccgtacacgtgtccggcttttacacgacacattgatatatacatgttcttttggaaaatttacaagtggttgtaatacagtagattgtctttgatactaccaactaaattcgtacgatggtatctttcttgcccttctatggcatgtaaatgaaacaaatacaattattgccatgaaaatcttgaaagatactgtcttgttcggattgttcgcctcttatgcggacggagtccgcaacggtgaggagaagctgtctgccgcctatgatgattttgccacgttgctggctacgctcccgacagacgggacaaacatctgtgcacagctgcgcaggctgttctacacgaaaatagagttgagggggattcaggagactgtttccacaaatggcatggaaaggcacgttctgttcgatgtttacatcggcaaggcacttgcgttgctggatgcggaggaacagatgatgaaagaggtactccggcatggtggaacggaggcaatgggattgaaggaagaggcggtatgcaggaacgggaagaagggttctgtaacgctgacgtggaacggcacggacagcgacttgatagaactggtggcggcgttgatggctgtcggagtgataggaacagcggaaggtagggagctgaaagtggtggatgtgatacgggtgttcgaggaagtttttcacttgaaaatcaatgccctatataccaagcgtggaaaggtgtttgaccgttgtacggacaccactccgttcatcgactccctgcgcaggagctacaaccggatgcttgacgcacggctggcgtaaaggttgcacgccaacagccgccaacggacgacttgtatgtgttcggtattgcggattggcaggcgaatggttttttttgccgtcggttattcacatctaaaaaaacaaggttatgtcaatcttgaatgatatttggaaccgtatcgtccggagaacggaccggcagaaagtgacagcaacggaagctgccggaacagaaaaacgggtgtatgccgtggccaccgaagagggggtgatgctgttctcggacactccgaaaggaatgaaggcacgtaacagttatctgcaacatctggccgacggcttcttcaacgtggccaaagtatctgaaactctgcggatatacgagatagacctgcctaccaaacgggtagcggaactggcagacaactgtatcgaaaagttgtccaaagcggatttgcggagtacggacgcacaattgcgcaggtcggtggtgagcttcactcccgacaagtttgcggacaggagtgtattggacggtggtgtgtgctgggcaaagtttgacctgcggcccgatttccataattttgaccggctgacaagggagtttgggctgggcatctcgccgcggaactatgatgtggcggcattgctgtacatttcggaaaacgggtacgccgggattgttgcggcagacaaggtacatcctttcagctatgagtatgagttcagggaactggcggagaaactggaagacagcatgaaggcacggatgaacgcgcctctgtcggcacacgacttcggctatgcggccttgcagaaagaggcaagggagatggcggcggacttgttgcaatcggagttccatgccaaggatggggagttcaggctgggcgcacggataagctggattgaaaggatggaaacgttacatccgatgtcgcgtccacattcggaagaggtgaagaccggcaagttaccggagacataccgcaggcaggaaacaccgagacaaaagccttctgacagacaacggcaggcgaggcacgtcgcccccattgctccgcaaaagaaagagaagaaacaattcatcctatagaatttatggaaaaaaagaaaatgcaggcggtggaaagcggtagcctgtacatgacactggacgctttttacaaacccgtgtatctgagtatacgcgggcagggggaagatggattctctcgttacatcggcaacaacgtgaggtttcatacggcgggacggagatttgttcccgaccactgaatgttccgtttcgattttagggacaaaggcatgattcctcccatactcggtacggacaatgcggattatctggaacggctctgtccggtgctggaacgggaaaggatacatccgtcgggggtggtgaggctccgggatgcggcattctgcgaggaaagggggattgcgcatctgtcatcatcggcagaacatatgaccttgctggaaaacgaggattacaggcgtctgggacaccgtttcggaatggacggggatgtgatacgcaacgggctggcggctttccccacctgcatggtggtggaatacgaggggaaggtattgctgtttgacaagacagacagtggggacaggatgctggatgcgtttctgagcaggctggccgaacgtttttttgacggcaagcggaaatccgggagtctgagattttatgaagtggctccgctggatgctgcataccgggctaaaatcggtgacggacagacggtttcttcggatatggtgagatacgggatttgtgtggcatgttgcgacatggcacctacgctgaggaacttcaacaagctgagaaatctgcaacggcagcctataccgctgaccggagagcaggagcagatagtctcgtcactggtggtacaaccggataacgtgcgattcccgaacgtggaaatgagggtgcggattccggtaaagagaaaaggacaaggaatgaacatttaaatttttggcggatggaaaaagagaatacgaacggcggcagtgtgtatgtcacagtggacggacatttcaaaccagtgcatgtcagcatgaaaggtacaggcgagaaaggttttctggagtttatgctggaagatgtggaaaaggcactgaaggaaacggaaatgcctgttataggcatgatgtactataacgtgcctgatatggggattgtaccgcatttgtgggaagggaacaatgatgattatctgcaaaggttggaaaaggcgatggacggacatggaatcaaactgcatagatacctgcgtctgtcagaggtggtgtattgcctgtgaaaagacatggatccgctgtcaagggacgagaattatatccagcggcttacaccggagatgtggcgggagataaaggctgcgtcgcccgaagtgacagcggagatgctggatgatttgaagcatggaaacacgtattatacgggcgttgagacggacaaaggggtgctgatattcagcagggacataatcggagagggccaatttagtgattacatgtataaatacatagagaatgatttctttgcctcggagtttgtgttgaaatccctggctgtccatgaattgaggggatggccctcgctgatggaagggaaactgaaccgttgtcataaccgtttcggctggtggggagacggggaaacgataaggcgggcattccaggacaggtcggtactgaaaaacgtaacagacagtgagacttatgactttaccccccccccacatgggagaactattacaggttgactgatgcaggcaaggggctaggactgacgcggagccaacataattatgaccggatgacactgctatatatcatggacaaaggttatccgagagacgggctgacagatgaatatccggacgagttcagtttccatgaaaaatttgaaaagatagaaaacaagttgctgggccggaacagatgggatgtgtatgatgagctgcaggagaaggcgaagaaactggagggaagctgttgaaggagcattttccgaagacacggcaaaaagcggacgtaaaggaaaaggcggttgtgcagaaaagcaaaggtataaagatgtaggataacggaaaactggtgaggggtggaatgctcgttactgcatggatgcaggtaacaggcatttccttttatgattgagattattaaagttttggtttgagcaaatatgggtaaaggaatagtagtatggaaatatttcaggtcacttcttaatatcttgtattttgaggagtgacaatgtgcgccaacaggtgactttgatttaggaagttttgtcggatgttgaaatgtgcttttatttgctttgtaaatagtaaaatcataaatcaaatttgttatggaattaattgttatagaaaaaagtgcgtatttacggttaaaacagcaagttaaggatttatctgtacaagttgaagccgttaaaaagaagtttggaacagttaaaagggagaaatgactggatacccaggaagtttgtctggctctgaacatctctaaacgaagtttacaaagttatagggattatgggatcattccatgttctttcattggtggaaaatatatgtacaaggaaagtgatttggtcagaatattaattcaaaaagataaatagagtatggatggggtaattacaaaacaatcagaagaatatattatgataatggggatgcttagaaaatgctcaaaggaaattcttgaatttcagaatttgcaggttcctgtagctaatgaggtttatatgactggtgagcaggtatgtagtatgttacatatatcaagcaggactttgcaaaagttgcgggatgaaaaggggatagcttatactgttataggtggcaagttcctttatcctctttccaaattgcaatcagtattggaaaaaaattatagaagttatcttcgttaaatcaagtgatgaatttgtatttatatttatattgctttttcgtatatttgcaaaagtaagtaaaagtataacaggaagaaagttgcagcatatatgcggtgtcataggagttgaggcttcaagtaagattcagataatgagtaaggaactttagagttaaggatgtgtaaattaaactgtgtcatgctctattctcattcaatctcatcggtctaggaacggcccggcgccaatgggcgggactaaccgtcccgacgagcgtaaaattacaagaatttaaacttatctccaaattttatcgccagttgttgagtaatggcttcccagttagccagtggcatagtccatttcttacgtatgttgcgataagcgaggtaaaccagtttttcaagggtggtgtcgttagggaacacacccttgttttttgtcactttccgtatctgacgatgatagccttcaattgtatttgtggtataaatcatacggcgtatatctgatgtgaactggaagtattcagtaagtttttcccagttgtcctgccatgacttgatgacgataggatatttttcttcccatttctcattcagattaaaaaaactctgtttcagtagcttatttatgtactgcaccataaacccgtttcaagtttttgaggaattccttctgatgcttactaccgacatatttaatggagttccgtatctggtagacgatacaaagttgtaatattgtgttcggaaaaacactttgggtggcatccagcctttcaggccatcaacgtacgcaataaggatatcatgaactccacggttctgcaaatccgtcagtacgtttaaccagaaatttgctccctcatttttagagatatacattccaagcaaatccttgtggccttccttgtctatgcctaagacgttgtagattgcgcgggtaatggtacaccctctctcgtcagtgactttataatggatagcgtttatccagactatcgaataaacatcatcaaggatacgggaacgccaaacctttatttcaggaagaacacgatcggttattgaactaatcgtttcgtcagaaacacggttgccgagattttcctttagccagtcactgatctcacgtgtgctgttaccaagggaataaagtccgatgatacggtctgctaccccctccgccaagatggcctcacgcttctttatatactaaggctcaaaacctgaattacggtcacgaggggtagacacagtgatctcacctaatggagtctggacttgcttctgcattttactattacgacgattacccaactgacgtttttcttctgtaagatgcgcatccatttcaccttccaatgctgcattcaatatactttccaataaggggacaaaagcaccatccttaccaacaaaggcttatcggttttcagctgttcaatagctttgttcttaatattttcaaaatcaaattctgctttcataaaaaaacagtgttagcaaagttaattccttgatgacacagtttaatttacattctctaaagttaattgttccctgtctttccagctttcagtagttttgtacacatctttttgatattaaaagttatagcaaagaatgcaaagtccattgtaaccttttcttctcccacatgccggaccttctgtatgccatgttgtgtttcatttgtccaaaaactgcttccggttctatacatcgccttcccctatgcctgatgccttcttccgagccgtaaccggagtctgccactccgacagttggtaagtggttatagcgttgctcaaaggagtggaagaaaggtatgagggtcagtgtatcggttgggttgggaaacagccggaagtctatgaggaattggttctcggtacctatttgcagattatatccgggcttggtctgtccgtttttcatggtgtcttctttcatgtgcatgaaggtggcatcaggatcggtcttggaataggagttgcgttctccaagagtatcaagatggttgtcgtattccatcaacttgtcacggtactcctcaagttccggacctgtttcttcttttctcgtatgactttcttttgttccttgtcctagtgttccagcgcctctttaagttcattcactatatctgagagcatggcaggagtgaactctacggatgtgcctttggaggagttctcttgggctatggcttcatctgcctgctccaggagaatgcggatcttatccatcagctttgtacggttcttttcgactgtcttgcgccagacaaaagtatatttgttggccctgaactcaatcttgctaccgtagatatgctctacgtcaaggctgataaaacctttgtcggcaaggacaaggaccaactgcgtaaatacggtatttatttcttcttttgcacggtttcgaaaacggttgatggtagtaaaatccggatgttcattagcggaaagccagatataatggatgtcacataggagaagcttctctattttgcggcacgaatagatattgttcatgtaggagtaaataatcaccttaagcatcattttaggatgataaggacaacgaccggttgctttataaagcttcttgaaattgtcaagattgagattatcaacaacagtattaactatgcgaaccggatcgttcgatgctatgttttcatcaattctttgtggaaaaagaacggtctggttggggaatgtaaggacgaaaatgtaactttgccataacaaaaaactttatgtctaaagatatagaaactttggataataacaaagcccgggcttgcgaagtctgggctttgcgcataaaaaagggtgtgccaacgttgaagtgcacctcaaaagttagataaaaaacttttggggtcatttcacatttgacacaatctctttcttttcaactttcttatacttttatgaccaaaaaagattatgtgcgtttgaatatgttaaaatatgacccgatttgtcacgtttaggtggtatttcttttttgtcgaactaggaattttgtttttgcgacctacagattttccatttcctgttttcagactgcaaatttacgaataatccatatttttatttctatatatgtaataataacaaattaaagaatttaataattccttaatattcccgaaagaaatgtgaaataaaatatatggaattttgcagcgagaaaaaatagtaagtatgcttaaacgaataattattgcattgaccattgcttgtttcgcactggcagaaacgaaagctactcccaaatatatcttcttatttataggagacagtatggggcttggccatattatggcaacggaagaatatcttagaaccaatgaatttgaacttctccttatgtttggatttcctaatgtcggaataatggccacattctccgcttcatctcctataacagattcagcagcagctggaacagctttggcatgtgggcataaggccaatagatgagtttggaaatatatacaagaaaaaatgtatagaacacaaaaataatgaaatcaatcaataactaatcattatcttatgagtgcattaacaagaaaattaattttgctgctcgtggtttgcataactgcaatcggagcagcagcacagacaagaacgcttagcggtgaagttgtcgaaaaaagcggagacccgttagtgggtgtcagtgtattcaatcgagaatacaagatagggacaacgactgacatagatggcaagtttgaaatcacacttccctccggcgtaaaaaaactgactttctcctatataggctttcaacctttggaaatagatttgaagcctgacgagaataaaataaccgttacaatgactgaagacgctcaagctcttgatgaggtcgtagtggtgggctatggcacacaaaaaaaggttaatctcacaggagcggtctcggtaattacagataaggagctttccgatcgtccgtcccagtcacttacctcaatgcttcaaggtacgactcctggacttaacatcacgacgggttccggtcttccgaacaaatctccatcaatcaatgtacgtggtaccacttcagtaaatgccaccaatcctctcgtcctggtagatggtgttgaaagtgatcttagccaagtcaacccaagcgatgtcaagagtatttcagttatcaaagatgcttcagccgcagccatatatggagctcgtgccgcatttggtgttattttggtcaccactaaggctggagagagcgatgatgcaacagggaaaagagccaggactacagttcgatacagtggcagattcggctgggaggcaaacaccaacagtacagattatgaggaccgtggttattgggctgtctatactgccaacttatttgccagagctaaagacggtaaaaatatcatagactacacagataaggatatggctgagttactggcacgtgtcaacgaccgtacagaacacccggatcgtccgtggatagttgaagatgtacgtaatggaaaaaaacagtgggtatattatggaaattatgaccattatcacatgaatttcagtgataaccggcctaaaatgcagcataatatatcactgtcaggcggcattggcgatgtaaattacttcgtatccggagcgtatgaataccgtaaaggcatcttgaaagttaatcctgatacctataacaaatataatcttcggtctaaaatagagtttcctgttacaaaatgggcgcgattttccaataacacatcactttactctacttcctataaatctcagggaaacggcagtatagaagacacattcggatattctgcaaatggtgcatttgcatgttatcccaacaagaatccggatggaacatggatatactcagtaccttatcagagtacaaaaatggcaaatggccgtcatattatgattggagagggctcacatcgtaatcttgaacgcaatatgagttttataaatacttcccgttttatagtaacccctatcaagcaattaagtattacaggcgatttttcatacaaatttgatcaggaccgtaattattggcgttcaaatcatttgaatttcaggatgtatcctgattccgaaatggacttttacggtattggggccggccaaaacaaacttactgaacaggtttatacatcgaactatatatctgtaaatgcctatgcaaattataatcaaagctggaatgataaacataatttagccgcaacatttggtttcaattatgaacattggcataaaaaaaatcttagtgcagtaggttatgagttatcatcagatgacctcgatgacttgaatctcgcaacaaccatgttttcaatgggaggtggtcagaacgaatacaagcttgcaggatggttcggacgtgtcaactatgattatgacggacgttattttgctgagattagcggacgttatgatggtacttcccgttttgcttccaataaccgttggggatgcttcccttccggttccgtaggctggagaatatccgaagaaaaattcatggaatgggcacgcccgtcacttagcaatctgaaattcagggtttcatacggaagtctgggaaaccagaacgtatcttctttttatacgttccttcgtatgattactctcagtgactttgacacattcaactttggttctgatacaaaggcgaaatattcgtctatcggagcacccatagcacaaaaccttacttgggaaacggcacgtcagtggaatattggtgcagatctagcgatgttcaacaatcgtttgaattttaccggagacatttatgtgcgaaataccgttaatatgcttaccgatggtattgagcttcccggagtatatggtgccactcctccgcagatgaacacggcggacttgcggacaaaaggatatgaactttctgccacatggcatgataatttgaagatattcggtcacaacctttcttattctgtttctgccaatctcagtaattatgatgcacggataacacgttatgataatcctgagaaagtatttgcaaagagctactatccgggcatgaaacttggtgaaatatggggttatcatgtagatggtctgtttgcttctgatgaagaggcagcccaatattcatcccaggtagatcttggagttgttgccaagaatcttcctcaaggaacatggagggcaggtgatcttaaatttgctgatcttgatggggatggtaagatatctgtaggtgaggactctgctttgaatccgggtgatatgaaaatcatcggaaacgaacttcctaccctccagtatggattctctggctccctaaactatatgggatttgatatttatgccttcttccaaggaaccggcaaccactattggtatccaaatggctataattaccaattttggggttcattttcggatcctgtggcaggatatataccacgtaactttatcgaccaatgttggtcgaaggacaacccgggtgcatatttcccccgccctctcggacagtcagcaaaaaatggtcagttaagctttgtaaatgacaggtatcttcagaatatccgctatatgcgtttcaaaaatctgacaataggatattctatccccggaaaaatactttcaaaagtatcaatccaacaattgcgcgtatatttcacagccgagaatctgtgttactggtctcccataaagaaacattccaaatatattgatccggaagccgccttcagtcgcagcagcaatcaacttaatgcgatgtattatccttgggcaaaaacctatatgttcggaattgatataacattataattaacagagaatatgaaaataataaaatatctggttttcaccgtagctgtcactctgatgtgtgggtgcaacgatgatcttgaccttctgccgaaggacagaatgtcatcggaagaatatttccgtacagcttcagacctggagctcttcacgaatcctttatataataacatccttcccaaagttcaatacaaggatcagagcgacatttatgtatgtcagtcgctctccaatgagctgatggggggctcctatcgtaccgtccccgcttcaggcggtggatggtcatggacagacctcagacgtatcaacactttgcttggcaacattgacaaatgcgaagattccgatgccgccgaaaaatattcggctgtcgccagattcttccgtgcgtacttctatgctgacaaaatcgaacgatttggcgatgtgccttggtacgataccgaactaagcgatactgatcctgaactctacaagcctcgcgattcccgcgagttagtgatgcagaaaatgctggaggatctcgatttcgcaatcgaacatcttccctcccgcaacaatgaggctgaagccccctataaagtaaccaaaggtgctgctctcgctttcaaaagcagagtatgtctgtttgaaggtacttatcgtaagtatcacaacttacggattgaaggacatgacgcagactattacttggcccaatcggctgatgcagcaggcaagctgattgacagtggtgaatattcgctttattctaccggctctccttctaccgactacaatattctctttgcagaggatgatgccaatccgaacgaatatatcctggccattagctaccgctatgcaatctttaacaattcacatggatcaaacgcacacatgttgttgagtaatcaaggacgtcccggctatacccgcaagatggtttgtatgtatcttaattcagatggaacccgatttactgaccgtcccggttgggagacgatgggatttaatgaagagactgtaaaccgtgacccccgtttggctcagtctatacgtactcccggttatacacgaatcggaaagaaagagattctcgctccggatctcggcgttgcaatcacgggatatcaacctatcaaattcgtacaagatcccacggctgccggaggcaataccgacagggcaagctattcagtaaatgatttacctgtcatcagatatgctgaagtccttctgaattatgcagaggcaaaggccgaactggggacattgacgcagtcggatcttgaccgctccgtaaatctgctacgtggtcgtgtcggtatgctcgggattgacatggggatgtcgaacgctatccctgatccatatctttgcgaccctaaaaccggtttcccaaatgtgaatggtgccaacaaaggtgtcatacttgaaatacgtcgtgagcgtaccgttgaactcgtacaggaaggcttccgttggtctgaccttatgcgatggaaagcaggatatgcaataaatgactctgatgataaatcattttctccatttatgggaatgtatattgcaggagctggagaatatgacttatccggtgatgggaaagttgacgtgattttttataatcagggtactcctaaacccaatgccggagttggagttcaggtatatgctctcggaaaggatatattgttgtcaaataatgatcatggctacatatattaccacaggagtgttccaagagttaacttcaatgaacaaagagattatctttacccaattcctatccatgaacgctcgctgaataatagcttgacacagaatcctggatgggatgatggtttaggtttttgataatcttaaattcttcatataaaacaatgaaacaacttataattattaccctcatctttcttgttggtcaagtaaaagcatcagggcaaacatattacaccgaggctacaaatagtgatatgttacatcaggcaaatcgtacaggagcctccactcgcgtcgagttcatacttcccgattccatcgaaggatatattccactgaaggcggatcttcatcttcatacatacttttctgacggacatctgtcgccgtctgctcgtgtccgagaagcttggctcgatggtcttgatgctatttcagtgactgatcacattgaatatcatccctccctgatggtatcgaggctcataatgtgaataaaaaaactaatgttaaaccaaagcaagatctgaacaaatctgttgaacttaccaagaaagctgccgtcagctatggtctgcttattattcccggtatagaaatcacacgtgagccaaaaggtatcgggcactataacgctctgttcacaacagataacaatggcatatatgacccggatcctctcaccgcaattcgcaacgccaaagctcagggagctttggtgatgcataatcatcccggttggcgccgtgaatcgattcaacacccagattttgaactaaaagcatacggcgaagggcttattgacggaatagaagccaacaatggcacagcattttgtcccggaactatagaccgagcaaaagaagacaacttattcgtagcatcgacgaccgaccttcacgatacatcgtttgaggaatatattggtagaggactacgtcgggacatgacgataatcttagctaaggaccgttcacttgatgcaatgagagatgctcttgaaaatagacgtaccatcggatatggtgcaggagggacattaatgggacaggaataccttttacgtcaactttttatgagttgtgtttccatctctcccgtaaatggtcataatatccaactcaagaatcctacttctttgcgttttatcattcatccggatggaaaaaatcctattgtactccctgaatttagctcaataattttgtctgacaaggaccgcgggttctctgtagataatgcatggacaggagctgattcatttttaagaatatcattataatcaaactgagataatgaaaaagtcaataaatatcctattttttacgttgatgcttgcggttttttctgcttgcatcaacgataatgagccgataatggcaaaagctgtactctcaagtacagaaaatctttctttcgagtcaactgatgctgagagcctgataatcaccatatatgctgatgctgaatggagagtcgatacgcctgactagattactgttattccttcaaatggtgtcggactcacagacgtgaccgtttgcgttaaggataattatagtgatggagaagttgacagtccacgcacagacaaaatagtctttcatgagtcaaaactctccagctatgcctatgttatcgtctctcaagaaggcgactgttatcgaggaatctctgaaatttcagtgaaagatatattctctactgacgatcattcatttattatagtgaaagacgctgtcgtcaacatagtaagtggaaacagtatgattatttctgataagttcagtcttgaagcaatgtgtgcgactactattactgatgtcaaagccggagatgaaatcattttgtatgggcaaaaacttactgatgaaaactcctgtgtgacgataaagacagaccgagtagatataatctcatcaggaaatttcataaaatatcccaattcgacagatatttacgactttgacaataaaatagatgaatggtcattcataatagttgaaggagtagttaacggtaacaccattgaattgaatgataagtcaacattttaggttaagaccatcttattggaatctaatttaaatggggatattcccaaaataagaaaaattaaggcaactaatttattgcgagttagttgcttttttgtatctttaagcattgcccccaaaaacggtttgacggccaaaacgggggtaatctaaactaaaaacacatggtaaagatacaaaaaatctccggaatcgaaccttgtttaggttttaccgagttcgatatgctaaaaaatatcgtcaaagttttgcaacgagtgaattaggtcgactccatgctctcttccctttttcggaactggtccgacaaatgcatttgaagtcttctcctttgggtcgtaaaagttatttttctcccgaaggtaaaatagccttgatggtcctgaagtcctataccaacttttccgatgcacaactgattgaacatttaaacggtaatattcattaccagttgttttgtggtgttcagattgatccgcttcatccgctgaccaatcctaaaatcgtcagtgcgatccgccagttcctgacgaatcgccttgatgttgagtccctccagcttattcttgccgggcattggaaaccttatcttgagaaccttcatgtctgtatgacggatgccacctgttatgaaagccgtctgcgtttccctactgataccaaactcttatgggaaggtatcgtatggcttcatcgtcatctgtgcaaacattgccggagattgcacatacaacgtccccgtaacaagtatcttgatgtaagccgtgcctaccttgtttacagtaaactgcgtaaacgcaggaaatcacagacccgtatgattacacgcgggctacttcagttgttggaaaagttgcttgaccagctggagcggattcattcatcctacgggaacaggcttacactatcctctgattaccaaagacgattctcggtcatacagacggttcttgagcaagggaagaatttatttgcaggcaaaaaagtgtccaaccgtatcgtgagtatcgaccggcattaccttcgccccattatcagaggcaaggaaaccaaatccgttgaattcggagccaaagtcaacaatatacagatagacggaatctcctttatagaacatatctcctttaaggcttttaacgaaggagtacgtttgaaagactgtattcatctgcaacaacaactgaccggggttagggttaaggcgcttgcagcggatttaatctatgccaataatgccaaccggaaattttgtactaaatatcatataagtacttccttcaagcgtaagggtagagccgccaaagatgagccgcttcggaagatcttacggtcggaactcagccgtgaaagagttacccggctggaaggaagctttggaacgcagaaacaacattactcactggccaggataaaagccagaaacaggaaaacggaaatgctttggattttctttgggatacatacggccaatgcggtatgcatgatagaaaaggtcgaaaagaaaaaaagaaaggcagcataatctgactaaaataagaggaaaagaggagaggttttaacttccactaaaaaaagatatatacataatgcatgggtgggaagaaaaaataagaatatgtaaataatgttctatgaaaaagatagaagactgggagaattgaacgaaaaaatcaagagaaaagctcacgtaaagtaaaacttttctcttaatttagaagaaagaggaacatttactgaatatcccaaaatggacaccttatcagagttaccggttactatgcgggtcatacttcgtcagtttcattcataatccccgttattattgaggataaaggcaggtcaggctattctgcaatttttgtaaaatacttaattataaacgatttacgtttaattatcaccattctgttttttactgtatttttaaatattacttacacaagtaaacacaatcaattctttgtctaactgaaaataaaatagttatcactcactttatagatcataggtaacactttagaaacgatcgaattacaatattctgttttattctgcatcaactcaaagaaccttttttcaagacaaaaatataaaaacgaatgtacggcactgaggatatttgtatgtcgtacattcgtttttttattatttgtcatcatcgattccattccatgacaacataatcctactcctgacgttcagaaaaggatgtagtgttttccgatccccttccttatagtcaataagaagatttttattcactagaatacaatattttgcataaatcaacaatttgttgtatctggtaattttgtaccctataaaatttaaaattgaagaatttatggctacagtaaaaattaagttcagaccatcctcggtggatggtaaagagggtacagtttattaccaagtgattcatgtacgtgtggcaagacagattagcacctcatacaggctgttccccgccgagtgggacaaaaggcgggcccgtatcgtcgccgctccgtccgatgagggaagacggcaacacctgtcactgctggagggtaagataatggaggataccgacaggctggagggtatcatcacaaccctggaacggagaaggggggcttttacggccgacgacgtggtttccgcctttaacggcggacattacagcctgtctttccccgtcttcatgcgggaggtcataaacggcctgaaacgcctgggcaagatacggaccagtgagacctacacctccaccctcaacagcttcatacggttcatggaagggagagatgtgttgcccgacgatatggattccgatctgatggtcgcatacgaggcatggctggaatcgggcggggtttccatgaataccatttccttttacatgcgtaacttgcgggcggtatataaccgtgccgtggagaaggggcttactgtccagcgtttccctttcaaacatgtctataccggagttgagaagactacgaaacgggcggtacccctgcatgtgataaagcggctcaagtcattggacctgtcatttgagcccgcaaaggcttatgcgagggacatgctactcttcagcttttatacaagaggaatgtccatggtcgatatggcgttcctgaaaaagaaggatcttaacaacggcatcctctcataccggcggaagaaaaccggccagcagctccttataaaatgggagccgtgcatgcaggaaatcgtggaccgttacaacatccccggatccccgtaccttctttccgttatcgacagaccgggaacagatgagaggaaacaatatatcaacgcctcccaccgtatcaacaggcatttgaaagttcttgggaaggaactggggatgtccgtccccctgacccattacgtggcgcgccattcctgggccagcgcggcccggagcaagaacatcccgatttcggtgatcagcgagggtatgggacacgattcggagacaacaacgaggatctacctggcctcgctggataccgccaccattgacagggcaaacaagttgattttgaaatccttgcagatataatagaatattgaacaaaaggatattcaggaggaattggagttgactccgttaaaaccatagactttgtcatatcattattaatgtatatgccgcaaaattaggaacttctaatctggtatactatgcgtcatcgcggagacctttacaataatgttgagtaaaaattgtcgtctcttcataagagatgtataattgaatgcaaaaatacacaaaatattgagaataaccacaaaaatgaacaaataatgggaataaaatatggactgatccttgaaactgccaaacaggctgttgagcaaagagtttcctagaagaaagcaaagtgcttattatcagattgttttattcacatgtatcacattatacatctcttatgaagagagggagctatagaacacttgctcaaaaaagaatgggacggttctgtagcacattttttacacttaaacggatacatttatggacggaatattaagttttgtttataaattaaaactgatcgggcgacagctgccagatggcacaacacggatcaaagacataaactagtttgagcgacgatgtcactgtatagtacagaaactcaacctaacgccatggggggcaaagcggagaacggaccagagacgatttctgatccggaggtaaagaaatataccggaaacaaggagataacatcctggtgctatttgtttatccatcatgccaaagtagaaactgtgagcaagaaattgcaaacagaacaataccgtatctttgttcataagagtatcgtctataaacgtgggaacaagcggataaagaaagaggaacaggcaaccatttccggccttgtctttatccaaggtgacgctaacaggattcaaaaattcttaaaagagaactttttcaatttatatttagtgaaggattgcagtaccggagaaatagccgccatacctgacagtgtgatgcaacctttcatgcgggtgtcggaagttattcccacccgtatccgtttcatgccccactcctttgattattattctgtggggaatcctttagtccggattacttccggtatcctttccggccttgaaggatatcgcatcagaatctcccgtgacaagtgcctggtcacttccattggaggaatgacagtggccattggaggcatatataaggagagtttcgagaatctggacgaatatgtccgtctgcggaggaagcagctggaaaaaatcaggcaatcatcgtatgtcacattcacaccgcttcaaaaggaaatagacggctgtttttttacaccccaaaatcaattggatataatgggcatggcggaaaatctcacgccgtgggttacaaggatgaaatccgatatggtaaaaaagaactttgatgaagcggtggaaatagcgttcttcctgcttgaagaaacaggaagctatttccggagtatatattacgattcccatatcggagacatgaaagacatgatgataatatgtgaaaaagtggatcaaattctggtgtctgttataaactgcatggatatatctgtggatttgaaggaaattgtagaaaccggacgggagtcgctggcagttcgttatccttttttgccaatagaataataaacggatgtcatgattattgctgttgattttgacggaacgattgtggaacacagatacccgcggatagggaaagagattccttttgccattgccaccctgaaacagttgcaggccgaacggcatttgcttattttatggagcgtgcgtgaagggaaactgctggaagaagcggtggaatattgccgcacccggggcgtggagttttatgccgtcaatgccaaccatccggatgaacaggtaaaaccggatatgaccagcccttgcaggaaagttaaggctgacttgtatatcgatgacttgaatatcgggaaattacccgattggggagctatctatgagatgatacataaccgatggagctatgaatgctatttgaatgaaacacatgattttaagcgttttcagaaagcatcatggtggaaaaaattgataaataaaaagaatacacattcaaaatatgaaagggaatgaggcaggaacaaccaatcgtgaaaaaggggagaaatttcaaagcggttggtttcgggaaataatccttattgtattaacagccatttgtacaacgcttgcaacacaaatattttacaaacagaatattacgtcacaaataaagatggaagttgcaaaagatttggtattggaacaatatcatatatataataaggtaaagtctttaaaagaacattaccagataattacttataaagggaagttcaatgtacgggaaaataagatttccatatacgtggaccaattaaaaaatgagaaaggtaaaaaggaaattctggattcggttgtaaaacaagatacaataacgattgttgctccgacatttatatttcaagattcagtttacgatatatttattgaaaatctgcactatatcagagacaacttgaatgaacttgaaccagaaacatacgaaattgctgtccaattgtttgatttattagagaaacatccaatccccgcaaaagataaacgaataaagtatgttttggtttcaggctggaatgagaaagaagtacaacaaagattcgaatatctcattcatgaaatgtataatcactttcaaaatcgtttagaccaatattttccctaaatatagggttggatagacgtaagtggattctgaccaaattagtggtaaatatgtacttactcgaattatgaggtaaatatagatgtcatcatcagtagtaaatagaaaaaaaaaggattgttgtgggtgtaatgcttgtatggagatttgtccgaggtgttgcattaccatgattgctgatgcaaaaggctttcattatccgaaagtagatacaaccgcttgcgttgactgcggagcttgtaagaaggtatgtccgtttgaggaggaaaatataaagttgaatatccctctcacagcttatgcggcatggaacaaggatagggaggaatatcttgcaagctcgtccggtggagccgcccatgtgttttcatcttatattataagacaaggaggcgttgtttacggctgtacatctgaaggaatgcatatccgccatattcgggtagactctttgtcgaacttattcaaactgcaaggatcgaaatatgtgcaaagtgatgtcaggggattattcagtcaggtaaaagccgatttaaaatccgggaaaccagtactgttcgtcggtaccccttgtcaagtagctggactgaaaaattatataaaatggatcccggaacatttgtatttggtggacctgatttgtcatggtgtcccgtcgcaacagatgttgaatgagcatatccatcatatactaaaaacgtccgcggaacagctgtccttcagaaaaggacagctattccgcatcgagataacatctcgatgcggtacagtgtattcctccgaaccttacggagatacgtatttcagggcgtttctggacggaatatcttataggaaaagttgctatcactgcccgtttgcacgcaaggaaagagtaagcgatgtcacgattggtgacttttggggattgcaagatgcggcatcacttcctttagagatttcagaaggtatcagcgtattgttaccatcttcagaaaaagggaaatcgctgattgccgcagcaaaatcagatatgtggatttatgaacgtagtgtcgaggaagctgtagaaggaaatacacaattgtatcgcccggttcacaatggtttatctgccagacttttatctatgctatatccgtatttcccatttgacaaagcggtaagaatagtaatagtcaaggatttgattcttgagtctttgaagaatatactcagatcattcaaacctgtgcttatgcctataatcaatgtcatacgccgataacaaacgcatagctaagaacacgatatacctttatataaggacattcgtgtcgatgattgtggctctttatacttcacgcaagattcttgaagctcttggcgtagatgattttggcatattcaatgtggtgggtggtatcatctcgttaatgtcttttatcaacggttcaatgtcggtggctacacaacgctatcttacctatgagttaggtagaggtacggaagggcaatttaacaaagtatttaatatggcggtatatattcatgccataattgctgtcattgttctgattgcggcggaaacgatgggcgtttggtttgtgaacacacagttgaatattcctgaagtgcgaatggaagcagccaattgggtgtttcaggccacaatactaacaacaattttaggaatactacagacaccttacaatgctgctattatttcgcatgagcacatgcacatttatgcatacgtaggattaggggaaactttagccaagctgtttattgtttggggacttttttattatccatacgacaggcttgctatttggggattcgccatatttctccttcaatttttaatagccatgatttaccgtatgtattgcagccgacaatttcccgaatgcaggcttcatttgagatggaataaggcaatctttaactctatggtccaatttacgggttggaatatgttcggaactattgcatggttattaaaagatcaaggcataaacatattgatgaatttgtttggtggtcctgttgcaaacgcagcacggggtgtatcttgccaggtttcgggagccatacaaaatcttaccggtgggtttcagagtgccgtaaatccacaactgaccaaaagatatgcagcccatgaatcagaggaaacttgcgacctcatgtgtaaaagctcaaaaatctcttattttttgctttttaccattgcattgccagtcatgatggagacagacttcattttggatttgtggttagtagaagtcccccccatgactgcttcgtttacgcgcatcattattatcgaagctttattaaatgcctttggaggtcccatgataacttcgctcatggcgacaggaaatataaaatggtatcaaattgtagtcagttcatcattgctattcattattcctgtggcttatctgttgttgaaaagcggttattccattgaaactccattgatagtttcggtcatattcataatgattgggaatattgtcaggcttatgttctgcaagaaacagcttggtctcgcattcaggcaatatacttggaacgtagtctttcctattgcgggtgtaagtgctttagccattatttttccgttaggcattcatgtttatatgaccgagggctggagcaggcttttgattaccactttcgtatcatgcacagctatgggagttttgacttataccattggcctgacagcatccgaacgtacatttattatatcttatgtgacacccaaagcaaaaaagtttttccatatagattaatcgtatgaaaaaagtaggaatcatcactttccatgccgcatataattacggttctatgcttcaggcatacgctttacagcaagtaattctgagcatggggtatgactgtgaaatcattaatttccggagtcctgcccaaaagcggcaatataagcccatctttgtggtaggatcgctttatggcagatgtgtacgctttatcatacaagcggcatacgtatggggaatattgaaaaaacagcgattgtttgaacaattcttaaatagtgaattgaagctgtcttataatgaatatggaacattggaagacttggaaaatgcaggattcaattatgactattacatatcaggaagcgatcaaatctggaatgtatattgcaacgacttcaactatgcttacttcctgccttttgtaaaatcaggcaaacgtattgcttatgctcccagtatgggtgcccaattaagcataaaaacatacaaggatagaaagaaagtcattgatttattaaaccaatatgatgcaatcagtgtaagagaagctgttggagcccggtatataagagaaataaccaagatgcctactgcttctgttcttgacccaactttgctgctgaatccccaggaatacgacaatttgatagatgacaagcctttgataaaaggcgaatatgtatttatctactctcctaatttcactgagaaagtcaatgaaatggctgaagcattgggtgacaaatacaataaacaggttgtcatctcacaagggctgataagtaagaatgccatgctgaaatggggtaggaaatttaatatatatacggctacaggtcccaaggaatttcttaatttgtgcaagaatgcttccatcatttgttgtgattcatttcatgctgtagcattctccattctcttcaagaaatgttttttcgttcttgacggaatggaagataaccgcatatccaatctgttgcaaataacacatctacagaataggaatttttcattacccaatgagtatcttaacgctccattgcaaattgatttcacccaacctcttgaatatctggaaatagaacgcaagaaaagtttggagtggttgaaagagcatctcgatgtctattagaataagattctatcaatgctgttacaattctttattaaagaatcgggggaacagaaaaatgaaacgggagtaatggaaaacatgcttatttgataattgcccacacagattggagcttgttaaaaacattggtatcattattggattatgaattgaatgacatctacatccatattgatgctaaagtcccagcaaagtccattccgcacataacttgcagcagaagcaagatatattatttggaacgccgtatctctgtcgcatggggtgatataagcgtagtcgaagcagagtatctgctttttgaaacagcttataataataggcattatagttattatcatttattgtcaggcatggacttgccgctgaaaccaaaagagcatatatatacattctttatgcaaaatgggagtaaaaatttcattggtttttgtccttataatgatacactttcggatattcgtgtcagaacgtatcatttctttgtcagtaaaatgcgggacaaccgattttataggttgttagacaggattatcgcaaaatgcttggtcgtttttggctgtttaagaaataaagaaatatatttcaggaagggttccacttgggtaagtgttacaaacgattttgtaaggtatatgctagcgaataaaaccatggtgttggaattgtataagcatacgttcggagcagatgagtttttcatccagactttatgttggaattcacggtttcggaatagtgtatatgatttgaatgatgaatataatggttgtcaaaggctgatcgattgggaacgcggctggccgtacacttggcaagaaaaagattacaacgaattgattgcttcagagtacttattcgcaagaaagttctcttcagaaaatgcagaattaatcaataggttgacaacattcctaaatacccagaattgaacatgtaacatccaacaatcacacccattgattcactaagaggtgtttttgacttgttgatagtttggcatcatttggcaccaacagaagtatctccatatcattacgattttggcagtaccattgttcttttcttctttattctaagcgggtacggcatatcattgtcgtggaaagataaaataagtgaaaaagggggcggtaaaaaattcctgtcccgtccttgttcggggtatttgctcaaagttgccaataaaatgtttaacgaactataggaatgaagacaatttcagtcatagtcccagtttacaatacggaagcttacttggaccgttgcatcaagagcttgttctgccagtcgtatgccgacttggaaatcatcctagtggatgatggctctaaagatggcagtttgcggatttgccggaaatgggaacaacgtgacagtcgtatacaggttatatcccaacccaatcttggtgtgtcttcggctagaaatgaagggataagaaaatcaacaggcgatcttatcatgctgcttgatagtgatgattggctggctgctgatgcatgcgaaaaactattggcactaataaaagggaaaaatgccgactgcatagtttgtgggctcaaacagacaagtggcaatatatgggctcctgcatttgacaaagactattcagatttggcttcattcaagtgtgactttatttattggataaacacggaactattaagttcatcggtgaataagatatataagcgtggacttataacagagttataccctgaaaatatgtctttcggtgaagatttggtctttgtattgaattatctgaaacattgcaatcgaatatcatttactcaagaaccactttaccaacatgaagtgtataattcagtttcattgacacattctttttcccctgcacgtttctccaatttggaggatattcaaaaggccattttagattttgcagacgataagaataaaatcaacccacgaatttacgataaatatgtgaaggatgcgttgcatttgacaagaatgtggtataaaaacaagaatgttccctatataagaaaaaaggaaattataggtgaatggctgaaacagtcttatataagaaagctgaaaatttccgattatcaattacattggaaagaccgcatgttgcttcatagcctacacatgagttgctttatcggaataaattggattgtcaatgggaaagaatatatcaattccctttctaaagaatgatatgcaaatgaaatacacggctgtgatacgaacattaggcaagggcggaaaaaattatcaaagattgcttgattccttacttgaacagaccatcagaccgacaagcattctcgtgtatatcgctgagggttatcctttgcctaaagaaacggtcggtatagagcaatgtgtatacgtaaaaaaaggtatggttgcacaaagggctttagcgtatgatgaggtatcaactgaatattgtctgtttcttgatgatgatgtttatttaccacaccacgcagtggaaaccttttataatgaattagttggacaggatgcacaagtgatttctccatgtgtatttgccaatcatgaagtagccataaaggataagatacgttcaagcatattgggcagagaagtctgtcgtctatggagtcggaagtggggctacaaagttttaagaaccgcaggtttttcctataataatcatcctgtaaaaccggtgtatgaatcacaatctaatgccggaccctgttttttttgccggaaagaagatttcctgaaaattcattatgaggaagaattgtggttagataaaacttactatgcttttcctgacgatcaagtcatgtattacaaaatgtataaaaccggtctaaaaatactgacctcttttgattccggtgtcatacatttagatgcaagttcgaccgtagaaaaatccaaagagaaaacagagaaactgatctattccgaataccgaaacaaactaatattttggcaccggtttattttcctgccggaaaagaacttattattaaaattttggtcggtgattgccattttttacgtttacggcattcagggcatgaaatatggcgtgaaatgtttgttcggtaataaggatatgtcagtggcttatataaatggagtggtggacggattttcatttttaagaagtgagggatataagaaacttcccaaaatcaaatcgtgtcaatgaaaaagaatatcatgtttatgatgcctgccttgccgggaggaggagcggaaaaagttcttattgatattttaaagaactttgattacgcatcttatgaagtgacattgttcttggaatataaggaaggtgtttatttgaatgatgttcctgaagaagtgagaatattggctttacattcgcaaaatacaatatggtttgagcgatttcaccgtgttttaagaatttttcatagctatgtcctctttcatacgcttgtatataaatatatgtttatgaaacttctgaaaggagaacaattcgatacgattgtttcgttcatggagggagctgcggtaaagtttcattcttatatcatacacaaagcgaataacaatctttcttgggtgcatatcgacttaaaacagaaacattggtctttagatttcttccgaaacgaaaaggatgaatttagagtctatagaaagatggataaaatcgtttttgtatcggaagatgtaaaaaggatgttcttggaactatatgcaatagaaaatgataaatgtaaggttatctataatctgattgacaagaatgttatccaacgattggctgtatcgaacaatgccataaaaaggaaattcacaatttgtatggtcggacggcttaatagacaaaaaagatatgatagggcattaaaggcagccaagtggttgaagagtgatggctatgattttgatttatggattatcggtgaaggaagccttgaaaagcccttgaaagcaatgagccatggatacggaatggatgaccgcgtacacttcttaggtttccggaaaccttcctatccttatatgaaagaagcagatatatatctaaacacatcggaagcggaaggttatcctttggttgtttgtgaggccttatgtttagggctggcaatcgtagctacagatatcagtggggcgagtgaaatattagccggttcggaatacggattgttagtttcagaaaaagatgaggacatctacaaaggtgtaaaacgattgatggatgatgcctccttgcgtgagaaataccgtgcgaaagccttacaacgggcagaaatgtttgatgtacctaccactatggcacaaatttataagatactgtaatgagtaataaggaaatcataagtttagccatagacagattaaaattccctttaatctgtggtgtggtcttcatccacaatcagttaaagggtgatatttctatctcgggacaatcgctctctataccggatgcgtcgtggtacgaggccgtcatcaatttgttctcctacgttattccatgtatagccgttccaatttttttcattgtctccggatatctattctttaaagaaggaacttttaatgaaaagctatatctcacaaagataaagaaacgattttggtctttgttaattccgtatgttttatggaatactttatgccttcttatttttatattcgtaagaattccggccttacatggtttgttccctaatgtttctttggaagaggttaccctgcccaaagttttatccggatattgggcgtgcgagggaaacggttttccttttgatttccctttatggtatgttcgtgaactcattcttatggttataatttctccgcttctatatgttgtagtaaagaaaatgaaagtttgttttttcattcccatagtcatctgtatgttcttctcattatgcccgaaggaatttggatttacattaaacgcttgttttttcttttcattgggattatatacgaggttgttttctcatgtgatagaatatgtagaacggttgaattttatcaagtatttgtattttctgctgatcgcagccgatttatatacagtgacattgggtttgccagttaattattatatacatttgttcgttattttctctggaattttgactgtattcaattatgtgtttatctcggttaaaaaaggaaaaaacggatgtctgtttaaagaagaggtctttttcatttacgcatctcacggattattcattgctttccttcaaaaggctgttctgaaaatcatgcgtcctataaccgaagttgaatttcttgccatatattttctcgtaccgattcttacgattgccatttcaatcgggatgtataggtgcatgaaacgtgtaacaccgaaagttttgtccatattggttggaggaagataagattgtctatgaaagtttcaatagtcatacctatatacaacgtttccgcttatattgaaaactgtttggaatcggtacggaagcaaatctatcaggatttggaagtgattcttgtcgatgattgtggcacggacaacagtatggaaatcgtacaggaatatttggaataccacaactttgttgaagtaaaaataatacaccacacgcataaccggggcttgtcagctgcccgcaacactggtttggaggctgcaacgggagattatgtatatttcttagacagcgatgatgcgcttatggaagactgcattttcatattggtcgcccccgtggaagcacagccttatgattttgtcatcggcaactatgaagttaaaggaagtaacaaggaatatccggccttaaccctgccttcgggagcactccgtagcaacaaggagattctacactcatacgctgaaggacgatggtatatgatggcatggaacaaattgtgcaaccggaaattcctgctggacaacaagttattttttgaagaagggctgttgcatgaggatgtgatatggagtttcaaactggcttgtaaagcctgctccatgtatgtaatccaagagccgacctaccgatataccatacgtgcggcctctatcatgaccggaacggatatagagcgagatgtcaaccaatacataaaggtatttaaggtgttaacccggtttgtcataaacgaaggcagacaacaagcgcaggatgaatacacacttttagaggggcggaaaagcgccttgttattctccttgttgcaaagaaacgaatatgggttatacaaccgttattacccgtacctgcacgaaatgtcgcccatctccccttggattgcatttaaaaacaagacgatgggggtaaaatacctgttgcgcgatttgcattacctgttgccagtgctatggggaagacaatacaagcgattattctacaacctgtattacaaatggagaggcaagccgatagaaggtgcactctggtaaaccatgagctataagatttccatcattatcccggtctatagggtggagaactatatatcacgctgttgcaggtcgctgttcgggatgcggtttcaagatgtggaatacctgttcgtggacgatgcgactcctgacgggagtattgccgttatcgaaagcgtcttgaacgaatatcctcataggaaggcgcaagtgagattacttacacaccaaaagaacatgggggttgcctgcgcccgtaataccggactcgaagcggctaccggcgaatacatcgcatttgtcgatgcggacgactggatagagaaagacatgtttgaaaagctataccaaaaagccgaagccggacatcttgatattacgggttgcgactggtatctggagtttgaagcatccagacgctatatgcggcaacccgtctatgaaaaggcttcggactgcctgattgccctgctgaccggagaaatgcgctggttcttatgggctttccttgtacgccgcgacctctatgtaaaaaacaatatccgtttccttgacggagccaatatcggcgaggacatgtccgtacttatccggtgtttcagctttgcccggtcataccgccatgtcccggaagccctttaccactatgtaagatccaacacggcttcgatgaccgccctcgattccaaaaggcagatagagatggtgaaacggaacgtggatgtcacgaccggctttatccatagcaggtatcagaacagcttggaacgggaactggactttctgaaactgaacgtgaagttccccctgctgatttcggacaataccgccaattacgaagtgtggaacgcctgttttcccgaagccaaccgttccatctggaaaaacgccaaacaaccgttccgaaacaaactgctgcaatggtctgccttgcaccgccattattggatagtaagaggctactatcgcctgctgttcaaattcgtgtacggaatactatatagatgatgactgatttgttgaaagccgttttaaccggtattgtgttcagttgctattatttcccgtttgagtttgtctccctgccgggaatcaatacaaagatgatgttggctgtaattggtgcggcattgtttgtcatgcaatggcttaaagaggatactcttcgactcaacagaacatttttggtggtttctgtgtgggcggccttattttccttgtcatcttttctgtccgttgtaatcaacaacacaacggattacacgtatgtgtcttttatagtcgggctgtgggtttggattgccggcgcctattcggtaatgtttttgataagaaatgtacatggttccatttcgattcaatgggttttccggtatatggcgtatgtctgtgccatacaatccattttagccattttgatagacaatatgccattacttcaggagtgggttgacggcttgatattgcagaatgttgaatatttgcatcgcgttgaccggttgtatggtataggtgccagctttgatacagccggaatccggttttcatgtgcgatgttaggcttaggatatttaatcgtacatgaaatttcaaataaacggaaaatatggtattggagtctttttctcattatcggtatcgtgggtaatatagtgtcgcgtacaacgacggtcggtttggttatttccattgtatatatggctttgtcgaacttttcactaaatggccagataacccgttcgcgggtaaaatttatcggatgtggcattgttcttaccggattgttagtgggaggcggctactatctgtacaactattcgccagtgttcggaaattatctgcgatacggttttgaaggtttcttcaactggtttgagaatggtgaatggacgactaattccacggacagattacaacggatggttgtatttcctgacaatttaaagacatggcttatcggagacggatggttcttaaatcctgatgattccaatggattctataaatatgtagatataggttatttgaatttcattttttattgcggcactattggagtggctatctttatatctctgtttgtccacagtacttacctcctttgccaaaaaggtagggaggatacctttttctttttgttgctgcttttgttgcaattgatagtttggataaagatctctaccaatatatttctcgtgtatgccatgcttctgttacttgacagctacgagtcctcagaagatagtgtcagaccgactgaaaaaacgccttatggtacctaaaattattcattattgctggctaagcgacgacccatttccggaaaagatacaaatgtgtatagaatcatggaaaaaggtaatgcctgactatgaattgaagttgtggaatacacaaacttttgatatagagaacagtgtcccatacgtaagagaggcatttgccaatcgtaaatgggcatttgtcgcggattatattcgcctatatgcactttatacggaaggtggtatctatttggattccgatgtgaaagtgctgaaacgtttcgatgattttctgcatcacaattttttcacaagtatggaataccatccgttcatggttgaacgggataactccttagcggatattgatattgacggataccgaattgctgataattatatatccggcattgaattgcaggcagccataatgggagcggaaaaaggatgcccgtttatcaaagagatattggattggtatcaagacaagcacttcattcgaccggatggtagtatggggctggatgtgatagccccacagatatatgcccgcatcgcagaaaattatggtttcagatataaggatattgatcaaccattgaccgatggtctgatgatttaccgctctgagatctttgccgggaacaggcgtgaggtcacgcctgcatcatacgccattcattattgtgaaaacagttggaatgaacgggctctattggataaaatccgacactattggagatttctcctatatctatttaaatcaaaaataagtagctaagtttatgatttacgttaacggaaggttcttattgcagaacttgacaggggttaaccgttttgcatacgaactttgcagggcatgggcgcaaatggggatacctttcacattgtgctgtccacccggtcccatcaagggatgttacgacgtttcccattttaacattgtagtgtatggttggggcaaatctcatgtctgggaacagctgtcgctacctttatggttcagcaggattaagggagagaaagtgttagtctgttttacaggcttaggacctttgctggtacggaagaaaattatgacgatccacgatttggcatttatggccaatccggattggtattcccgtccatatagaacatggtatcgaatgatgactcccctttgtgcctccacatccatgaagatattgactgtaagcgagttttccaaatcagaaatcatgcgcaggctttcaatggatgatgaaaaaattcgtgtcatttacaatgctgtttcttcccggttccatgcttcagagagcagccgtaggaatgcaggggaagttaccggagagaaatacatattggcagtatcttccattgaccctcgaaagaacttctccatgctattgaaagcattttctctaatagaagataaaaatatcaaattatatatagttggaggacaggctcatatttattctacctccattaaggaattatgtgataatatccctaccgacagaatcaaatggttaggacggataacagacagtgaattgaaagaatattatatgaacgcatgttgctttatctatccgtctctttatgaaggatttggtatccccccattggaagccatggcgtgcggcactccgaccattgtgtcggatattcctcctttacgggaagtttgcagtaatgcctctttatatatctgcccattggatacggaagatattgcaagaaaaataatgttattggtctcagatatagaattgcgagaaagacttcgtatagcaggctataatcagtataagcgattcacatggaagaatagtgcaaatgccgtctatgatcttttgtgcagtttataggtcaaaaagtaggaaaaaacagcagccgttttgtaggttgtacaaaataaagagtaatgatttttttcttgataattatcgttctattatatattctttcttttcgttcctttaatgagagagtcagtcctttcaataaagagcatgtttctatattgaaaggggtaatggcaatgtctatagtcgctttccatttgtcttatcaaactgatgactggttattcatgttcagttcttggggagctcctgtcgtttccatattctattttatatcaggatatggactggcgttcaattatagagccagaggaaatgaatatctgtcacatttctttaaacatagaattttggggaaccttattcttcccttcctgctggtatggattgtcaatagaatcgtaagcggaaacatttcaatgagtttattggatgaactcattgaattattgatgcacggagagaccacattgccctattcatggtatgttttcagtattcttcttttttacattctcttttatatgatagctgccaagcggaatgttgtaatcatttcattcctttgtgtctttacatatatagttcttaccgtttcattgagttatgaacgctgttggtatatcagtgcgttagcattcccattaggaatattttattgtaaatatgaaaaaagaatatgcgcattatggaatgtaccggtaagatattatgtgacggtccctttatgtttgctattgacggcggtatgcgtaattagtaaaaatgaattctgctatttgttcgcctatatgcttataccaatcattattgtgtgtctttgtgccaaaatacaaatctataatagaaatatgcaatggataagcaatgtctcgtatgaaatttatttatgtcaaggtatcagtatgacattgcttaggggaaattatctgtttatcaaatctgatttattgtatatcattgcaactttcgtgctgactttctttatggcttatagcataaaaaagattgtgcattatttattaataggcattaatatggaaggtcaaaagacatgatattacaggagtcttaaaagatggaaattttgaaaatcctccaactcggtaaattctacccggtgcgcggcggtgtggagaaagttatgtacgacctgatgacgggcctttcggagcgtggcgtggactgcgacatgctgtgcgccctgtcgcagggcggctcgcgtaccatagccatcaacgcccacgcctgtctcattggctgccgcacctggatgaaggtggccgccacgatgatctcgcccgccatgattttctccctgaggaaaaggtgcggggagtatgacatcatccacgtacaccatcccgacccgatggcgtgcctggcattgttcctttccggctacaggggcaaggtggtgctgcattggcacgccgacatagagaagcagaaaatgttgctggaattataccgtcccctgcaggaatggctgctgggacgcgcggacctgattgtggggacaacccctgtctatacggcggaatccccctgccttgcccgtgtgcagcataagacagtatgcctgcccatcggcgttgcccctgtcgtttccgagccggaaaaggcggacgcgctgaggaggaggtatcccggcaggaagatcgtcttctccctgggacgtctggtggcatacaagggctaccggtacctgatagagtcggcccgctacctgactgacgactatgtggtgctgataggcggctccggcccgctgatgtgcgatctccaggcggaaatcgagacctggggcgtggaggacagggtgaagctgttaggcaggattcccgacggggatctgccggcctattacggggcctgcgatgtcttctgcctgagcagcgtgcagaggacggaggctttcggcattgtgcagatagaggccatgtcgtgcggcaagcccgtggtggccacccgcatcccccattcgggcacctcgtgggtgaacgggcacgggatgtcggggctgaacgtggcgccggaggatgcgaaagcactggcggaggccgtcatggagatagccggtgacgggcaggtatacgggaggttcgctgcgggtgcgggggagcgttaccgggagctgttcaccaaggagagaatgattgataacgtaatagatatttataccaaactatgaatgagacaaaagttatgtcaagggcggcggaagccgcatttgacggcagtgcctgccgccggggcgtcgtgtccccggccgcccgcagggtaaagaggggcctggacctcgtggcgagcgtcatcgggatgctcgtcttctcgccggtgttcctgatcatctacatcgccgtaaagtgcgaggacggcgggaaagccatcttcaggcaggaacgtgtgggctatcacggggagattttcacgctctacaagttccgttccatggtcaccacgtcggagtcggacggcaggccggcattgtgcagcgggaagggcgacaaacgtctgacccgtgtggggcgtttcctgcgcgagcaccatctggacgagctcccgcagctgtggaacgtgctcaagggcgagatgagctttgtcggtccgcgcccggagcgcaagttcttcgtggacaagatcagggccgtcaaccccgactacgagctgctgtaccagctgcgccccggccttttctcggccgccacgctctataacggctacacggacacgatggagaaaatgctggagaggctgcggatggacctggactacctctacaaccgctcgctgtggcttgacacgaaaatcatcttcctgacggtgttctccatcctgacgggaaagaaattctgaaacgaaatggaaaacaaggacaagcttataccgaaatccggcctgaaactccgcaggataggcaaccgccacatgattgtggaagtctccgacagttgcgtgaacctgacgaacgtgtacagcctgaacgggaccgccgcccggctctgggagatggtctgcaacggggaaggccgtacagcgggggaactggcggagggactctgcaagacgtatgatgtggaatacgggcgcgccctgcgcgatgtggaacgccagatagaggaatgggagaagatggggctgctgtcccggcggggcaccggcgattgaatgcttacactgaaaggacaaaggcatcttgtgatcccttaccggagtgcctgctttagaaaacggattccatggagctttcttcggaacataaggcgttgttcagcctgctgcgtgcggggctgtgggagagggagccggacgacctgtcacccttcccgcttacggacgcgcagtggtgggacgtgtaccggatggcggtgcgccagaccgtgacgggcattgtctgccgcggcctgcaccacctgccggaagcgctgctgcccggcgacgccctgatgatacgctgggtggcggagaccgaccgcatcgagcggaagaacaggaggatggacgcggtggtatgcctgctgacgcaacggatgggccgtaacggcctgcatcccgtactgctgaaaggccagggcgtggccgccttctatgaacatccgctgacgcgcgaatgcggggacatcgacctctgtttcctttcggaagaggaggaacgggaagccgcggagctgatgcgccgggccgggtgccggacggagaaacagccggacggaagcaactgttacagctggcagggagtggaggtggaacaccatacccggctgttcgaccttcataacccgttgctgaaaggctacctttccgcactggtcagggaacacgggttcacggagttccgtccgggcggaagggacgggctgccggagggcaaccagcccggggagttcccggcgacaatctccgtgccgtcccccctgccgaacctgctgttgctgaacgcccacctcctgaaacacctgctggggcacggtgtcggccttcggcagttctgcgacatggcgcgggcctaccacaccctgcacggaagctactcccccggggatctggaagccgttcacaggcggaccggcctgctcaggtggagcgcgcagctccatacattcctgacggaatacctcgggctgcatcgcgccgaacttccttatgcggatacggatgcatactcctctcccgaactgctgcgcatcgtgctggagggagggaacttcggacagtacggcggcaccaagggcaaggcttcccaggcaaggtgggaaaggaaactgcgtaccttcctctccttctggaaacaccgcggcttctccaacacctacgcccgcaaggaggcgttctggatttcggtaagactgataataggaaacctcagatgagaaacgaatattttttcagggtggcggggctgacgttctccgtcatccttcccggtgggctggacgcggagacgctgctgccctccttccgtccgttccggtgcggagaatgcccggaaggggaacggattttccggctgcttgccgacacccgtccctttgcggatgacgggaaacgcgcggagctgctggacgagtcgtccaacgacatggggcatgtatgccttctgcgcattcccggcggttaccggacggagataagttacggtcctatggatggtggcgcacatctcatgactgtggacaccgcttttgacgatgccacggccttcctccgggtggaggacccgtccgtgggggaggtactgtcgtccatgctccgcatcctctacgcccaggcggcactcgggcgggacgccgtttccgtccatgcctcctgcgccagcctgaaaggcaggggctaccttttcctcggcaagagcggcacgggcaagagcacgcactcccggcaatggctggaggcctttccggactgccgcctgctgaatgacgacaatcccgtgctgcggatagaggacggcatggtatcggtctacggcacgccgtggagcgggaagacaccctgctacaggaacgagcgccgtcccgtggccggaatcgtccgcctgcaacagtccggcacgaaccggttcaccccgcttgaggggccggaagctttcgccgcattgctgccctcctgctccgccatccgtcaggacatccgcctgcatgacgaactttgccgtatcctgatacgggtaaccgaacaggtgcccgtcggacggttggaatgcctgcccgaccgggaggccgcatggctctgtttcgagagcctgtacgtgcgggatgcgaaagcccgggaagtacgggacggcctgccggagaacggcggactatgaacgatgattgataaaccctaaataaagcaaagaaagcaatgaaaagaaaagactgtttttggattgtggcggtggcagtgctcctgctctcctcctgcagttcgtcgaagaaattcgtctacctgcaggacatggagatggggctcggctatccgtatgacaccaggtatgaggcggtggtgcatgccaacgaccgcctggacatcaccgtgagcagcaagaaccccgagctgtccatcccgttcaacgcgggcggcggggccttctcggtgggtgccaacggcgcggtgacggagtccgctgccgtgaagaaaggctaccgtgtggacgtggaagggaacattagtttccccatcctgggcaagctgcatgtggaggggctgaaggtgagcgaggtgaccgccctgatacgcaaccgcatcatcgacgggaagtatatcaaggacccgctggtgtcgctggagttcctcaatttcaagtattccgtcctgggcgcggtgggcaacaccggcaccttctcggtggagggcgaccgcatcaccctgctggaggccatcgccaaggcgggcgatgtcacccaaaggggccgggtgaaccgtgtggcggtcatccgtgaggaggacgggcagcgggtgatgtaccagcacgacctgcgcagcaaggagctgttcgagtcgccctgcttctacctgcaacagaacgacatcgtctatgtcgaaccgaaataccgcaagcaggaccgcgaggacaagggctggaagtacaccaccggaatcctctcgttcatcacggccgtctgctccgtcatctgggccatcaagtaaacacatctctgaattatgcaaaacaacagtttatccaacaagaacgaacagggcgtcaacttagtggacctgtccgtctatctgctgtcgaagtggaagtggttcgtgctgtccgtgctgcttttcggggggatggcgtggtaccactacgccaaatccccgctggtgttcttccgctccgtcacggtcatcatcaaggacccgtccaacaagacctccacggcggggctcgaccgctacgacaactatatcaacaaggtgaacgtggccaacgagattctccagttccgttccaaacggctgatgcgcgaggtggtgcagcgcctgcacgccgacgtggactaccgtgtggagagcgggctgcgtatgaacgagctctatacgctgtctccggtgaacgtctccttcatcaacgtgctgcccgaacggcacatctcgttcgtggtgacgcccaaggacgatgcgacggtgacgctttccgggttcggggggctgcctgccgccaaggatagctatgacgtgcggctgaacgacacgctggccgtcggcggcgagcggatattggtgacgggtaccgaccactggggcaagtcgtggacgggtcgcgagatccacgtcgtcaagaacccgctgaacgccgtggcgggacgcctccagggcagcatgggaatccggcaggaggaggacgagtcgtccatcctcgtgctctcgctgaaggacggctcgcccctgcgtgccgaggacgtgctgaacacgctggtgaacgtgtataacgcggaagccgtcaacgacaagaaccaggtggcggtgaacacctccgagttcatcaacgagcgcctgctcatcatcgagcgggagcttggcggcgtggagaccgagctggaatcgttcaagcagcacaaccaggtgatggacatcggctcgctggccggccgctacatgggcgaggcacaggcctacagcgccgacgcgctggagcaggagacccagctgaaactggcgcggttcatcaaggagtacctcaccgaccccacgaaaagccgtgacctcatcccctcggggacgggcatcagcgacgccgccgtggaggggcagataaaccagtacaacgccctgaagctgaagcgcgacaagctgatagccgacagcagcgagagcaaccccgtggtggaggagcttaacaacagcatacacgccctgaggcagagtatcatccgtgcggtggacaacatgattgtggggatcaacatgaagcgcaacgacgcgcgcagccgccaggagcaggcacaggcgcggtttaccaccgtgcccaccaaggaacggcagatgctctccatcgagcggcagcagaaaatcaaggaggcgctctacatgttccttctcaaccggcgggaggagaacaccctctcgcaggcgatggccgacaacaacgcgcgcaccatcgacagcgtggacggacccgcgggacccatctcacccgtgcgcaaccgcatcctgctgctcggggtgctcgtcggcctggccgtccccggcgtggtgttcctcatgatcctcttcatggacacccgggtacacagccgcaaggacctgaagggcgcggtgagcattcctttcctcggcgaagtgccgcaggacaaggaggcggcgaaagcgggtgttgccgtcggcgaggaagacggcatgctggccgagagtttccgcatcctgcgcaccaacatgacattcatggtgaaaaaagacaaaccgatgcaagtcgtcaccttcacttcgtttaatgaaggtgcgggaaagacgttcatttcccgcaaccttgccatgagcctcgtgctcacccggaaacgtgtggtgctggtggacctcgatatccgcaagggcaccctgagccgccacttccataaacacccggtgggcgtgaccaactatctggccgacgactccatccgcctggacgacatcatccacaccgacgggaaattcgacaaccttgacatcatctcatctggtacggtggcacccaaccctgcggagctgctcatggacgaacggcttgacgcgatggtggaggaactgcgccaacgctacgactacatcatcgtggacaatgtccccgtgggcatcgtggcggacgccactatcaccaaccgcatcagcgacctcaccatcttcgtggtgcgcgccggccgcctggaccgccgcctgctgcccgacatggaggagctttaccgcgataacaagctccgcaacatggcaattatcctcaacggggtgggcccgcaccgccgtggctacggttacggatatggatacgggtatggctatggttacggatacgggaaacacgggagaaggaaatgaccgatatacttcaagcatttacgtttaatctttttaaatataattacattatgacacaagaaatcaggtatcagattaacgggtggccggaaaagacaatccatgccggcacagccccgtcaagaggtcccgggacaagtccggaggcgatgacggaacctcccttacagatacgggggcgtatgctgccctatacggaagccgtataaggcagcttatcactaaataaggatacattaactttttaaaacattaaagtatatggacgaaaatgaaaacaaaggcttaaaaacttacgagtctccttccacgaagaaaactcaggtggaattggaaggaaacctgtgcggctctactaatcacacggctcagtcgcccggtacaacaactacggctcaggaagtcaaccaatcttttggaacagcgaatgactttactaatgattcttgggataataactaatgaataagaacataatctgaatgaatatgaataagagatttttgattccggctcttgcttggtctttgctggctttaagctttgccggttgtacagatgacaatatgtcgggtagcgatcccctgccggaaggtacggaattcgatttcggcaccacggttgaatccaaccggtcgcgtacctattatgatcccacggatgaaaataacccggcggctacctcctggaagattttctggaactatgagtcttctttgtatgaccacatctacatctactccccccaggcgttgacaagcgccaaccaagcttcgtacaccgtccaggccacggcaaaggattttgcagaaccggctccggttgtcaaggacggtgatgtcggcgtgcagacaagtgacgcttcgagttacaatttctatgccatgtatccggcacagttcgtaaggtcgggtagtggcactggcacatcgctttccgccacaatgccagtcgaacagacggtttccaccacggaaacgatgacggacgaagcagttggcactctccagactgccgccgacatgaactgtgcgctgatgattgcgaagacagagaactataccccaactgccgagaatcaggcggcagttcagttacagttcacgccctttgcatcgatgattgacattaccgtaaacggtaccgcccaggacaatatgcagggtcgtaaggtacgcatcacttccgtcatcatcgaggcagacgctcctattgccggcgactttacatataattacaacacagacgagattaccttcggcgaaggcgcttcgaacagcattacagtcgatactaagtttgccgataccaatggcgacaaggagggtgtcatgatgggtaatgacagccagctcaaggtgcgcgccttcatgattccaaatccaaatgtcaagtcgcttaaggtaaaggtcgtgactgcagagtcaaagaccatgaccaagactttagcaatggaaagtttccagccgcgtcagattcattccgtgaaacttccgaagatcgacatcgataatttgaagttcgattacacgatttggctgtcgcagctcgatccgaatatctacatttccgagatttcgttgccgggttccgcgctgtcgttcaactatttgatgtcacaaggacacatgcagacccagacaaagaatctgtctgaacaattcaatgccggtgtgcgtgtgttccagtgccatgtcaataccatcagtcagacctccacgatagacggcggatccacgtcggtgggtatcgctgcttctgacggttcgaacgtaagtaaaggtaacggcagttactggactctcggtgatgtactgacagcactacaaaaggagatgtccggaatccacaaagatgagttctgcgtgctcgccatctccgactggattaaagacgtaaatgctgacaagttgtctgcgttgtacagtcgtttgaatgccgtgcttgacgaagccggaaaaatgggactggtcgcaaccaatatcacccccgaaaccaccatcggtgacatcaagggaaaagtgattatcaagttgcagcttaacggcggatataccaacgcatggacgcaactgaataatagcaaggtatggatgaatacctacgcagaaattgcagaaaccaccccgtattattcacccatgccttatggcaaacaacctgcaaccaatgccggcggcacatcggctttggctctgaccggggatatgaatatcatctactctgattgtgccaatccggtaaaatctgagtccaatttttcatggagagacggtgttcggaacaatgcaaccgccattctttccgcatacgaaaagaattacaattcaaccgaccataagaacttcgcgatgacctatttgggaggttgcggtgctaaatatactacggttttgtggagcaattattataatccttcagatgtcgcctctacccttaataaattatggcttgaaaacaaaagcaaaccggcagcgaagccgtggggttgggtaatgttcaaccttgtaggtgatgagatgacgaccactcagggcatcgaggccgtgattgagcacaactcagtcttcaagctcgcccgccgttccgccgccaagacgaagccctcgggcgacacgaagggcattgccagcggaggtactgtattctgattcctttttacctgcgaggcagcacggtccgtattgtctcgcaggctaatcctgtagaaaagaaaatagatgaaaaagataacaattgcaaacgcaataaccgtgctgaccgtatcggcattcctgatagcctgtaatgccgacgaccaagatttgttaccgggaggcaacaccataatcgaggctgtttgtccggctcccacgcttgagaagccggcgacacgtacggctgtcgaccccacagagtacacatccggagagattggcatcaactggctgccgaccgaccgaatcggcgtgtacggtgccaccactgccaatgcctgcttcaccaaccagagtgagcaggagaccgacaagacctccttcgcaggcaccctccagaacggtgagactcccctgtatgcctactatccctatacgaagacggcaggcaccgttcccacggctctcaatggcacactgccgctgacccagcactattccaccgccacccgcgaactggaaggcgactggaaggtgggtcacccccaaggcagttccacctcaaaattcactttcgagcacatcttcgccttcttgaagttcgacatcaacgccggtggcaccgacgtggcgggtgaaaggctgctgagcgtgtcgctcaccgtccccgacaagcagctcggcggcggcttcacttgtgacctttccacccgtgccgtcaccttcacgccggccaccgatgcctccaccgtgaccatggaatggacggatacgccggaactgtccgcctccaccttccacggctacatgaacgtggctcccgtcacgggcattgcggggacggaaatcagcattcagatcaagaccaacctgcacatcatcaccttcaccgagacgatgaaagccgatgcgttcaagtccaatacctattacacggtacctctcaccctgtcgcgcttcaaagacaagtggacgatggaggagaatcccgatgccaaggaggagaacgccgcttgggtgaccggcctgcagagccgtctggcatgcgccaacaccgtttttgccattgcggggcaacccttcatgcacaaaatccgcgtgccgcaaagcacctcgcagcaatatcatgcggttgtgcccgtaaagaatggcgtcaagcgtgtctacaacctgccggagggactgacctggaacgccggccgctgccttgtggaaggtaaggctcccgccgccggcgactatgtctattcggtggaattcaccgtagggggcgctacctataaagaaggcatcaagctccacgtggccgtccgggccgccgatctccagtcacccacccccatgatgggttggcagacctggaatgtctttaaagacaagattggctacgacatcctcgcgagccagcttgtaggaatgaaggaaaaaggcctcattgacgccggttacagatacttcggcgtagatgactgctggcaggtgaaaagtgagaacgacaacggccaccagattcccgatgcaagcaagtttcccacggcgaatggcgtaaacggcatggcgcgcatggcgaacctgattcacgactacggtctgaaagccggtatctacaccgattgcggaaccaagacctgcgagaagtacttcgcatcgtacggctacgaggaactccatgcacaggactataagggctggggctatgacttcgtgaaagaagattggtattatgaccttgatatggctcctgtcggtgcgactccatcgactttcgttgatggatatgccggtctgggtagctattggaacacgtccgaaatggcgcaggaactctacaccaagatgggcaaggcgcttaacgaccgcggcctgatgctgtacgtgtgcgaatggggtatccacgacccatggaagtggggtgccgagaccggtgctacctgctggcgcatgacctatgaccaccgtgacggctggtggggtaaaatcgacagtggtctgtttggtaaaaagaatgacggcgatgagaatgctaacggcgtgggtgtgcacaacaccatcgtactgatgcgccacctttggccgtatgtcggaatcaaccgttacaatgatgccgacatgatttgcgtcggtatccgcggtagcggccagtcgtcgagcgactgcgtttacaatcaggcgggtggactcacttcaaccgaagccgagacctcgtttgccatgtggtgcatgtggagttctcctatccttctgggcttcgacatgaccaaggatatgagttcggccgacttggcacacgacctcgcgcttgtcaagaacgaggagcttatcgccatcaaccaagatgccttagggcagggcgccgagtatatcaagagtgctgacggcattgattactatcagaaagacctcgctgacggcgatgtggcgattgccgctgtcaacctcagcgataattctgcaacttacaccatttctatggccgactacgatgctcttgacctaagtgaatcttattcggcaagagatcttatcggacagaaagacgcaggaaccctttctgcttcgtcatcgttgaccggctcgcttgcggcacacggcacctttgtcgtaaggctgaaaaagcagtaagcctggctcttgcttctaagcaagaaattttcttattcttggcatcaatacttttcggaggctatcagtgccaagagtaatataaagaaacaaatcattaacagttgattgaatatgactaagaaaatctttttgaccgccttgtgcgcagtggctctttgtccggccttcgcacagacttccgatacgaaagaaaaggtggagtacagtacggacaagtataaggtggaaaccaaccgtttttgggacaactggttcatcagcgtgggtgccggtgggcaggtgtattttggtgaccatgacaagcaaatagacttcggcgaccgcattgccccggcactggatattgctatcggcaagtggttcactccgggaatcggtatccgcttcatgtacagcggactgaaaagcaagggcgccacacgtgatgactgggaatgcgacatcacccacgggacaggcgaacatgtgcccggatgggccggcgttccgggcgacgacctccaatattccaaatacaagatgagcaacctccacgccgatgtgctcttcaatgtgctgaaccttttcggtggttacaacgaaaaccgtaagtgggacctcagtccttatgccggcctcggctgggcacgtgtctatgactctccatcttccaaggaggtaagcgccaacctcggtatcctgacctcctggcacttctgcgacgtactggccctgaacctcgacgtgcgtggcatgttcgtcaacgaccgtttcgacggtgagggcggcggccgtttcggtgaggggaacctttccgccaccatcggcctgacgtataagttcaagcaacgcagctgggaccgcagcaagaccgtttaccgttacaattatggtgatctggaaagcatgcgccggaaactgaacgacatgagcgcggagaacgaccgcttgaagaaagcccttgccgatggcgacaaacagaaggcacagaccatcgtgaagaagattgcctccgccaacctcgtcaccttcaagatcaacaggacgaagctgagcaacgaggcgcgcgccaacttgggtctgctggccgaaatcatcaagtcgggcgatccggaaaccgtatataccatcaccggctatgccgatgcgggaacgggtagcagcaagggcaacgaacgcctgagcaaggaacgcgctgagaacgtttacgactgcctggtgaaagagttcggcgtcagcgagaaacagctccgcatcgactacaagggcggtgtggacaacatgttctacaacgacccgcgtttgagccgtgcggttatcacacgtggggaataaaacatttgttcatataggaacttgtccgattctggtcagccgtcagactgggcgaaagccttgacgcggatttcgatacacaagaccggatttcagacagaccacatatttccgtttcccggtcggaaaacaaatataaccgggaaagtaaaaagatgttaagacctatgtcctttgtgaaaagcgcggggattgtaaggaaggcggaagactctgtcttccttacatttctatttgtcagaaaaaaaattattaacctgtcaattgtcattccggaaggatttcttgacatggtattatgaattatgatctgaatacaaaccatctgttatacaattatgatgaatatatgcacttttttatgtttcatggcgtgcgcctttgtactcgctgcctgctccgactccgacgaggatgttatcgtgcagggcggtttgaccggaaactggtacagcaccgagaacggaacgatttataccgttgaatttcacaaggaagggacaggggagttggtgacttacacctactcgtcaataccagatgtgaccggatatcatacgggatggacggtggaaggcatgtcgttctaatacacgctcgtagagaatctgcttaccatgaaactcgcagtaggggaagtgcttgtcgcggtggcaggcattacgggcaacagcatgtcgctcaccgatggtgattccgccgtcatgcttacccggtacgatggaggcgaggaaaaaatcaacgagctgagaaaggaggtggaaaacaattgtgatgtattagaaccggctccgatctatcccaacgaggaagaaagtttctgggaagaggaaagctgtgcaaaatgcaatccttggcatttacagcaacttacggagttatgagtacagacagttgctgctggagaagataaggcttacggggaaagactttgatgaacaccctgcgtccgtcattactccgtatgacagtcatgtggccgatgtgtggagtgcggcctaccttgtcatcagcaacgccaatatggtgataaatgccttgaagcctttgacggctcctatgagcgtaccgcttacatcaacgaggcgaaagccttgagatgcatggtctattacaacctgtcacaactgtggggcagtgtgccttacattacggtgcccgccacttccaacaattacgatgaaatcctgcattcccccgtacggtcaccgcaagacctttgttggggactgctcaatgaactgcaagacatcacccgtttgcccggaggttgtgtaaaaagtaagaatcaagtgttctttgacatattgtattaaaaaggcaatgctctttatctctttattttggtatttctattgttgtcctttggcgaatgaccgctattaggtatacttaataccccaatagtggacttgttgcaatagtacctgtatgctttgaatgttagtcactcttcttagattatagcatgttgcgtacaaatctatttcagcctgtaccttttcctttcctctgagtaggagtggtatttgccccatccagtatttaagagttccgaagggatgttctacccatgtttttcgtaaacgtataagcgctttgtatttcatccccttacacttcttcatatactgtcttatgggttcggcatctgcccttcggtagataatccggcctttttttgatgtggtgcagaactttatcaagggacaacccttgcagtctcttccctgatattttctataaatctttccatgtttacgaacttgcctgtctttaataggtaatatcttttcttgggagcatatataatagtcattgtctgcatcataggtaaaaaagattccgtgctcccgatcttctttaggagaatggtctccttcattgaaaggaacggcaatcactttgccttcttcttcaagggccagaatctgttcttcattagcataaccggtgtcggcaacggcttgggatacttctacctgaaggtcttcctgcatggcatgaatcgaaggttgaaggtcttcaaagtcattcgggtggtcggtaacctgcatggcacctatcaggtgatgttgggaatctaccactgattggatattgtaagccggaacaaaaccgttacgggtcttcatcaggcgagcttcgcggtcagaaggaaagcttctttgggaaccttcatccagcatacgctgtttttccgcctgaagttcttcaacctgttggctcaaacgggctatcttctccagtagggagctctccacaccggctcgtccgagagttcggataattgttcctgggctgtttccaccagatcattttcattaagctggtgcagatacttctctaaacgggtatccaacaaggctaactgtcgattaataccatctaaagtaagaccgtcacgattggtattggctttgattttactgccgtcaacagctaccagtttgcctgaaatataaccggaactgaccagaaagcggcggaaatcaaggcaacattcatgaatgcccgaagtttgtttggaacggaaatcggcaatagtcttatgatcaggatggagattacccagaagccagatcaactccatattacgcagagtctcgcgctccagtttacgggaagaactgatactgtttaaatagccgtagacatacagcttgagtaaagtaccaaagctataagccgaacggcccgtaggactgttacctttataagatgaaaaatcagggtgcaatttgataaactgatcgacaaaaacatcaatcagacgaacagggttctcacaagagatataagaatctaaagactcgggaagagtcagttgattacggtcaaaaggttgaatatagcccataaaattaatcctattgttagcagagcaaagatataaaatcctttttatacaatatgtcaaagaacacttgattcttactttttacacaacctccccgaaggcgggtggcgtatcactatggagaccgtcaaggccctccgtgccgaaatcgctttgagcctgggctacaatgacgaggcgggatacctgcttcgcgactgtcagtccgatttcagcattgcggtcgaggaatcgtccgagcccgaaatgtaccgcgttttcggtgaaagccttgcgaactatacacccgcgaaaaccgccctgctgctcaaagaggccggtatggaggacactgcggacaagtcggccctgccggacgaatggaaaacgcggaagcaagactggggctattggatcatgttgaaacggaccgggcaggcacaggccgtggccggatgcgaagcctacgagcttctcatgccttttccgcaatccgaaataaaccttttgcccgcgcttacgcaaaatccgggatattgacaacagggaagtgcggcacaagacatggacaattccgccctgtaggaactgtatgaaccatgaatacgacacactgtcagaacaatatatacccctggcgggttcataccacagccgtggaatgtggtatttccggctgtacgaattaaatccgctatcatttgtttgttttgtttgcttatccatatccgggccaggcgtggttcggatatggatatttggaataccgtatttatcggaattcataccgcggctgtccgtcatcgggaggcggcgtatcatccggataaggaattatatacgaagggaagcgggcatgcgtgccataatttcatctcaacatccaaccagtttgatatggcagtcggactgcacgcatagcaatgatgccgcctccccgtcggcagggaagccgggataagccccggacttccctgcttttgttttatacctgcgcgatcggccccgttcccggccatcccgcagtctcacgtaggcgtcacttgccgggggagcccaccggatgcatcctgataacggcgttacagagccgtgccgtctgttcctggtgggtgataatgatgagggtcttgccttgaatggtatgtgaaagccgttccagcagcgtccgttcggtatcggaatccagcgaggaggtgggctcgtccagcaggacgatgttaccggggcggagcagtccgcgcgcgatggctatgcgttgcgcctgcccctcacttatgcccgttcccatctcgccgcagggggtgtccagtccttgcggcagttcccgtacaaaatcggccgccgccgtatgcaacgcttcccgcatctgcccgtcggtagcttcgggattgcccaacagcaggttgtcgcgcaatgtgccgctgacgagcgtattcccctgcgggacatacacgaaattcccccgtgtgagtggagaaacgggcacgggccgggtcttgtcatacagcgtgatgtttcccccgtcgggctgcaacaaggccagtatcagccgtaccagcgtactcttcccgctgccggtctccccgagcacggcggtcaggctccccggtttgaaatcgtatgtgaaatgttccagcaccttacgtctgccgccgggataggtaaaagtaacattctccacacggacaccagccttgccacccaggatgacaggctcgccctgttcctccagcggcatggagttgagctcgtctatcctctccacggaagtcagtgcgccgataaacaccggaacctgccgggccagctccacgacagggcgttgtacctgcgccaccagttgcaggaaggcggccagcgtgccgaatgttaccgtaccggtgtccagcccgtatattccccatgcgaaagcggtcacatagccgagggcgaaccccgcctgcaccatgatacttgaaaagatggaaaatgagttgcgccgcatcaccagccgtttcagccccgactggagtgaggacatcgtgtccgctgccaccggggtgcattccaggacggaaatcagggtgcggtgctgcaggttctcctgcagatggctttgcacacggctgtccgtcgcccgtatctcacgtgtcagacgccgcatccgcttcatgtagagcttgctgcacagcaacgccaacggcatgataagcaggatgacgacagccatccgccggtcgagacagaacaggaacagcgcggcgccggccagttggaacagcgtggttccgaccaaggggatggaacccgccagcaggtccgtcacggtacggacatcctcctccatgcggttgagcatatcgccggaatggaatgtctcgcgaccgttccaccggcttttcaggatatgttcgagcagatcctgccgcagtctgttgcgcaggctgatctccgtgtgcgcatagagacggctgacaagtgcggacagcagcagttgcaggacgatgcatcccgccatggccgccagtcccaggatgatgttcccgtccgcctgatgggtggcggtatctatcaggtgcttgcagaaccagacgaacgtgagggacacgccgatgcgaactgtcccggcaagaatacccgccagaatgggggagcgatatccccgtgaggcgttccacagccattccgctccttctttcatactcattcccgccttcatatccatacccgtctgtatatgtacagcaaataccggcgaatagggagcagcctgccccatatcttcgccttgcaccgttcaccccctgcgtcgcagtccacataacggccgttacggataattcttgtgacaactcccgttatatcgggaaaccgacaactttccgtttcctttagattcccgtcgcccattaggacaatctccgcgccatggatgcggacgatacggtgcagcacataccggctgtcgggcaggtgtgccagggcgatttgccagacctgtaacgcctgtatcccggagggacgccgtacaagcacactgtcacgccctccgacaatgaaggggagcatgctgtttcccgtagccttcagcatgaccgaccgtccgtcggccagcatgttctccacctccccaagcaatgaggcgttggggagcagaagcctgtcggcatgggcatgattgaatgtatcgtctgtcttcattttcatactgcaaaaatagtgaaaataaacggaaataagcggccgcaaacagcctttttgtagggcatcgaacagaaaaaaggaaagggagtctgttggtaaacgtcccaagtgataatataggtgaagctatcaaattatatgatgaagcgactctggagcttggaagggctaacggtttaacggcgtaacgcgctgttaaaccgtctggttttcgtttacccaaaagacaacttgctgtccgcaggagcggaccacgtatctccaataattattgtgtatcagactattgcgtggctattttcctgtgatttgttgggcatttccatcagatattagccggctgttctccccattaaagggtagatatctcttcataaccatgtgacttacgcccataattcgagaataaggaggcgcatatacgggaaatctgccctttaatgccctattgtccaagcgtaagggcagagccgccaaagatgagccgcttcggaaaatcttacggtcggaactcagccgtgaaagagctacccgcctggaaggaagttttggaacgcagaaacaacattactcactggccaggataaaagctagaaacaggaaaacggaagtactttggattttctttgggatacatacagccaatgcggtatgtatgatagaaaaggtcgaaaagaaaaaaagaaaggcagcataatctaactaaaataacaggaaaagaggagaggttttaacttcccctaaaaaagatatgtacataatgcatgggtgggaagaaaaaataagaatatgtaaataatgttctatgaaaaagatagaagactgggagaattgaacgaaaaaatcaagagaaaagctcacgtaaagtaaaacttttttcttaatttagaagaaagaggaacatttactgaatatccataaatagagttagagtatggatggggtaattacaaaacaatcagaagaatatattatgataatgaggatgcttagaaaatgctcaaaggaaattcttgaatttcagaatttgcaggttcctgtagctaatgaggtttatatgactggtgagcaggtatgtagtatgttacatatatcaagcaggactttgcaaaagttgcaggatgaaaaggggatagcttatactgttataggtggcaagttcctttatcctctttccaaattgcaatcggtattggaaaaaaattatagaagttatcttcgttaaatcaagtgatgaatttgtatttatactgcttttttcgtatatttgcaaaagtaagtaaaagtgtaacaggaagaaagttgcagcatatatgcggtgaattatgcggtgtcataggaattgaggatttatgtaagatgctgataatgagtaaggaaccttaaagttaatcgttccctgtctctccgctgaactatccggacaaaaccgggcaatgaacagtcaagtcccacaaattcaatgatttgtgggactttttttatcccattatgtctgctctaccggacatcatttagacggctcagtctgaatactggatcagcctgaatatttggagccattcaccgaaaatgtaaaaatagaggcagatatgcaatacctctagaaaagaacactagaatacatagtatccaatatagagaacggctattttaaaccactagtgtctatttaggacatattcgaatttatagaaacatctatcgatggtattcaacgggatatagtactgcatcaatgctatcagcttgaagtatatactacttttatacctaaaaagcttgatccgcaaaaagttgatgaacgtgttatacaaaaatgtgatttacctgcttggaggagattatgataaagtaaaagatagccatttagggtaaccctttccgtaatttattgagtaattttgcacttaaataatgagacgtgtatgaacattaatactgaaacaaaatattgccaaacgtgtggaatacccttagatatagattatgccagtttagaggaaggtcagaatgaggaatattgcgactactgcctaaaaaatggagttaagtcgtatgacttctcaatggattacctcatctacctttgggggcttttccccgaagaatattatagagaggtcggaataagctattcttcatcggaattaagggaaattatgtccaaacgattgccggaaatcaaaagatggaagcaaaaaatcaacactgcccatgtgcagtacgaattaattataaaagttcaggaatacattaactgccacttgtttgacgacctcgattcagacaggctatcccaagttgcaggtatttctaaatttcattttcgtagactttttaaagcaatctgtggtgatagtcttggaaattacatcttccggctaagattggagtacattgcatttaagttaatatcgacagatacaagtgttcctgaacttcttagtcaaatcaattatcagaataaacatacgctttcaagagcatttaaaagttattttaattgttctataccagaatttcgcaagaaacattccaatgctcgccccgaaggaaagaatccaatacaggttgagttgagcataaagaaagtgcacaacatgcgcattgcctatttgaagttggaaaggacaaataacatcagtcatagtttttctctcttatggaaacagttgttacaattctccgaaaactatgaactgccatcaaaaggatgccaatatgtaagcctgactcttgattatcctttgattacgcctgaggagcacagccgttttatggttggagtaaccttgcctcaatcatttgagacccctaaaggctttggcatgtatgaaatttcttcgggcgaatatgccatctttcgtttcaaaggattataccacgagctaaatagggtgtatcgccatatctaccttgactggttgcccacaagtgattatacgttgcgagagcctttcacttttgaaacgtatatcaatacacctgagaaaactccggcttcggagttgataacagctatttatatccctgtaacaagaaaagaaacatgaaatacctgaatcaagagatagaaaacgaattaagaaatcaaggagcagaactgatacgctttgttgatatatcacacttgagtgaaacacaaaacaggcaattccctcatgccattgtatttgcacttccgctgacagccggatatataaaagaagtatgtgatacccccgattacgtacaggcccggatagatgacaattataatttcgatgacgacgaatactccattaccgaaaacaggactcataaattggcagataacatggcagcgtatatagcagaaaaaggatacaacgctttttcgcaatcggatgaaaaccttattgccgagggaaaatttgatgcagcacataaagagtctcttttgccgaataaaacgatagccttgctcgccggattagggtggattggaaaaaacaatctgttaatcactcctgaatatggtgcggcacagtgtctcggtacagttttaaccgatgccccgttggaaacgtttttgtgtgagactctccatccgcattgcggaaagtgcactgcttgtgtcaatatctgcgagagaaaagttcttaaaggtaaggtttggagcacctctgtttcaagagatgaaatcgtcgatgtatatggatgcagcacctgcttaaagtgtttagttcattgcccgtatactcgtcggtattgtaaacaatcaacaaaatgaggagaaataacaacataaaatatacctataaacaaattgggggtatcacatttcccattcttatcagcctgctgatggagatgatgataggcgttacggacacagcctttctgggtcgtgtcggagagatcgagttgggagcatctgccatctcgggggtgttctacttgattatatttatggttgctttcggtttcagtgtcggagctcagattcttgcgatttcctcttttgtttttaagttattaatttcacatttcggcaataaattgttccaaaatgatatttctttttgagatttttctaacatatttacccattgtgtatagataggatttatcaagcaagcctcaccatatcttgctctaaacaaagtccaatgataagtcggtgccaagagggtatccttttcggaccccctcatcttatgtctaagtttaaatattagtaattaaagacttgcaaaattgaaacataatctataactcggcagataaaagaagaaccgaaaaaagacaccgaatgttagtgatgttatgaggtaagagttagggaaaatttgcagacaggaaatttctctgtatctttgccgacatggcgcaaaaaggtgagttacatataagaaataagcacaatggtcaatacgattttctgttgttgatagaaaattatcctccacttaagagattcgtatcacttaatcctctgggtgtacaaactataaacttttttaatccgcaagcagtaaaagctttaaataaagcattattaatcagttattatggcattcggtactgggatataccgaaacaatacttgtgtccacccattcctggaagagcggattatattcattatattgccgatcttattcagccggatagggtagcgaacgatttgcagacagaggaggaagatgcgaacgaacagaaaacgaaatgcagatgtctggatgttggggtaggtgcaaattgtatttatccgattatagggcacacagaatatggatggacatttgtgggcagtgatattgatccggtctcgattgagaatgcacggaagatagtgacttgcaacccggtattggcacataagattgacttgcgacttcagaaagacagtcggaaaatttttgatggaattatcatgcctggcgagtattttgatgttacgatctgtaaccctccgtttcatagctcgaaggaagaagcggaagacggaaccttgcgcaaattgagtagcctgaaggggacgaaggtgaaaaaagtacaattaaattttggcgggagtgcaaatgaactttggtgtgagggtggagaaatccgttttatactgaatatgatctccgagagtcagaaatatcagaagaactgtggatggtttaccagcttggtttcaaaagaaaagaatcttgaaaagctatgtgctaaattgaagtctgtgaatgcatcggagtataagattatcagaatgcagcagggaactaaaagcagcagaatattagcttggcgattttctaataactcataataatgagtgcttattgatctgttatttttaaacctattaaataaaatattatggaaacaaattacatcactttgacgaaggagaatattgcggacgaacatatatgctgtgccttttcggataagaaatgcaaagatagttatgagttaaaaaaagcatggctgaaaaaagagtttgataatggttatgttttcagacgtattgacgaacgggcgaaagtgttcatcgaatatggtcctgctgaaaaggcgtgggttcctgtcagtgctcctaattatctgatgataaattgtttctgggtgtcgggtaaatataaaggatgcgggcatggtaaggctttgctgcagtctgctattgatgatgcgaaattgcagggaaaagatggtttagttaccgtagtgggcacttctaaatttcattttatgagtgatacaaaatggctgctgcgacaaggtttccaaactatagaaaaacttccttacggattcagtttgttggctttgaaaataaatccggctgctcccgatccttcattcaacgacagtgtcttgacaggtgagtgtcctgaccgggatggaatagtagtgtattatactcatcgttgtccgtttactgaattccatgttcgcggttctttggtcaatgcagccaagagtaaggatctcccattaaaaataatagaattagaaaccatggaacaggcacaaaatgcgcctactccagccactatctttactcttttttataatggtaagtttgttacgaccgatttgagcgtgtgtattgaagcccggttgggaaaggctttaggcttgtgattctgtgagatgaagatttatcagaaactaggattgggataagaagatagctaatgtttcttattttaattttgcaaaattaagatgtaccttgcactttttatggaaaatacatatctttggatgttgaatgattaaaacacggtaagaacttatgcgtttttttgtatgtattttggtgcttttatttgtacataatcaattttcgagggctgataaaactttaacagatgattctctgtatacggagaaatatatcagggatatttatattcccgaacctaggcgtgctctgcaattactggacgaagcggagaacaggaaaacgattcctttgcgggttgtaaatgaattgcgtagtttatcatatagtaatatgtatatgaataaactagcatttatgtatgcaaggaaagcttatttgcttgattccctatatcaaaaagatccgaaacacatgctgaaaatgacagtacatttggctgaattttcggcaatgatgagcaaatataatgaaagtatgcgttatgcattagatggaatcaggcaggcgcaagagttagggaacagggaagccaaagccaggttatttttctgtatgggagagaataattggagattatcttttaaagataaagcatacgattattttaaccggactattgagcttttgcggggctcaaaggagaagcgggaaatgatgttgctctcttattactatggagcagaaatgagctttttaatgaatgattctcgaattgaagaggcattgaaagtgggttttgagcgtgaaaagcaaattgaacggcttaaggcagtacctcaaatctctgaagattatatagacggtcaatatagttatttatatgccaaattagcctacatctattgcatggagaagaaatatgagaaggcggagcaatattatcagaaatacttatcaaagaaagaatctcatactcccgacggaaaaatgtactcggttccttatttagtgctttccggacaatatgaaaaggttattgataattgcagggggttcaaggaattgatgagaacccagcaggatactttgaatgaacagtatctgactgtccttcgacaggaagtgaaggcatatttgggtatgcataaatacaaagaagctgccgagatacgtgaaacgattttaactataacagatagtatcaatacccgggatagaaacaatgctgcattggaattgaatgcaatgtacggcgtctctgaaaaagaagaatatattgccgaacaggcttttcaattaaaaataaggaatattaccctctgttttcttgcatgtattgttgtactgactctgtttgtcgtttggcgtttgtggcatttcaatcatatagtcgagtataagaacaggatgcttgccaggcttataaacgagaaatttgctaatagaaaagatgggaaccagttatcggaagtatacgaacaactggctgttgtgtcggaggttgaaccggaacgtatttcacccgaagaactggaagaacttgctaacgatacagataaagaaagtggggaagaagaagagaataagaagatatttcaggaactgaatgatatcgttattcagaaacagttatatctttcttcagaattgtcgagagaagatctggcacaaatcgtacatctgaataacgcacgttttgcgaggatgataagagaatgtaccgggaccaatttcaatggatatatcaatgaattgcgcattaattatgccattgaactgatgaaaaagcatcctaactatacgatacgtgccattgcagatgaggccggatttaatagcaccccgattttatacaatctttttaagaaaaagacgggaatgactccttacgaatttaaaaaagcacaggattcgttacagaattgagtggattctgctaaacaattttcgcattttccggtttatctatttataattaactattaatagagatgatacaggtaaggataaagcgggtttacgaagatttttcagaaacagatggctaccgggtactggtagataaattatggccacgtggaatgaagaaagaatggcttaagtacgattattgggcaaaagacatcacaccgtcttccacattgcgtagatggtttcacgaagatattcccggacactgggaagactttgtcatacagtatcagaaagaactagatgcttctccctcaatggctgattttctgactcttatcaagccgcatccggtgataacattgctttacgcttccaaagaaccggtgtataatcatgcccgtatcctccgcgattatctggaaatgcgtttgaaagagtgaaattaaagtaatttttatctgtttacgctttctgtcgttcactcaatttcctacctttgtaatctaaatcaaaatcgtgtaatcatgaagtataaattattggttcttgatgtagacggaacactcctcaatgatgcgaaagaaattagtaagcgtacattggctgccctgttgaaggttcagcaaatgggagtacgtattgtgctggcatccggcagacctacttatggcctgatgccgctggccaagatgcttgaacttggaaactatggaggttttatcctttcctataatggctgtcagattatcaatgcacaaaacggggaaattctgtttgaacgtcggattaatcccgaaatgttgccgtatctggaaaagaaagcccgtaaaaacggttttgccttattcacttatcatgatgatacgatcataacggattctcctgaaaatgaacatatccaaaatgaagcccggttgaataacctgcaaataatcaaagaagaagaattttctgctgccgttgattttgctccttgtaagtgtatgctggtgagcgatgacgaagaagcactggttggtctggaagatcactggaagagacgattgaacggagcgttggacgtattccgttcggaaccatattttctggaagtagttccctgcgctatcgacaaagccaactctttgggtgctttgctggaggtactggatgtgaagcgtgaggaagtgattgctgtgggcgacggtgtgtgtgacgtaacaatgattcagttggccgggctgggcgtagctatgggacattcacaagactcggtgaaagcctgtgccgactatgtgactgcttcgaatgaggaagacggagtggccgttgcagtggagaaggctattatagccgaagtgcgtgcagccgaaattccccttgaccaactgaatgcgcaggcacgccatgcattaatgggaaacttgggaattcaatatacatacgccgacgaagatcgtgtggaagcaacgatgccggtagaccatcgtacccgtcagccttttggtattttgcatggtggagctactcttgcgttggcggaaacagttgccggactcggttcgatgattctttgccagccggacgagattgtagtaggaatgcaggtcagcggaaaccatatatcttctgcacatgaaggagataccgtgcgtgcagtaggaacagttgtacataaaggacgttcctcccacgtatggaatgtagacgtgtttacttcaacaaacaaactggtgtcttccatacgggtagtcaacagtgtgatgaaaaagagatgaccgacgaagaaataagtaacttgacaactattgatgcatttattcagcggaagcagccgtttgctgtttaccgtattcccggagagaaagttccccgtctgttgacgcaggcggaaggagtggtccgtttgatatacgatttgaaagaactgaacggacagagaggatttgtaattgctccgtttcaggtgagtgagtcatgtccggttgtattgattcaacccgatcagtgggggcagcctttaccggtggatgatgatacggaagaagaccgggagatagccttgcgcctgcaagggcaagaatcatttctgacttcttccacggaagaatatacggcatgctttcatacctttataaatgcgttacgtgacaggacttttgataaactagtgctttcccgtcatcttacagttgataaagtagctgatttctctccttcgtccatctttcgggcggcttgtaaacgttatattcattcgtatatatacttatgttatactccgcagacagggatctggctgggaagcactcccgaaatcattttatcgggtgagaaagacgaatggcatacggttgcgctggccggaacacagcctttgcaagatggcagactgccgcaagtatgggatgaaaagaaccggaaggaacaggattatgtatcttcttatatccgtcgtcagcttctttcactggatatccatgctacggaaaacgggccatatcctgcttatgccggtgctttgtcacatttaaaaaccgatttccggttcgctttgaaagataataaaggtttgggagaccttctgaaagttttgcatccgacacctgccgtatgcggcttgccgaaggaagaagcctatcagtttattttgcagaatgaaggttacgaccgccgctattactccggctttatcggatggctcgatccgggagggcgaacagacttgtatgtaaacctgcgctgtatgcatatcgaagataaacaactcactctttatgccggcggtggattattggcctcttcggaactgaatgacgaatggctggaaacggagaaaaagttgcaaaccatcaaacggctgattgcagtgcctcctttaaaatcataaactattaataattatcatcatgtatacagacaagaagaacatactccagttggttgcgttgcttgaggcgcatgggattactaaggttgtgttgtgtccgggtagtcgtaacacccccatagtgcatactttgtctaaccatccgaattttacctgctatccggtgacggatgaacggagtgccggctattttgccatcggtcttgcgttgaatggtggtaagcctgctgctgtctgctgcacttccggtactgcattattaaaccttcatccggctgtggcagaagcattttatcaaaatgttcctctggtcattatttctgcagaccgtcccgctgcctggatcggacaaatggacggacagactgtaccacaaccaggcgtatttcagacgctggtcaagaagtcggtaaaccttccggagattcatacggaagaagatgaatggtattgcaatcgtctggtgaatgaagcattgctggagacgaaccatcatggaaaaggaccggtacatatcaatatccctatttctgaaccattgttccagtttacggtcgattcgcttccagaagtgcgcgtcataacccgttatcaggggttgaacgtctacgatcgtgattataacgatttggtcgaccggatgaataaataccagaagcgtatgattatcatcggtcagatgaatcttatctatctgtttgaaaaaagatatatcaagttattatataaacattttgcctggttgacggaacatatcggcaaccagacagttcccggtattccggtaaagaacttcgatgcggcgctttatgccatgcccgaagagaaggtagatcagatggttccggagctgctgattacttatggaggacatgtcgtttccaaacgattgaagaagttgctccgtcagcatccgcctaaagaacattggcacgtatcgccggacggtgaggtggtcgatttgtatggctcattaactacggtgatcgaaatggacccgttcgagtttctggagaagatagccagtttgctggacaatcggactcctgaatatccccgtgtatgggaaaactattgcaagatcattcccgaaccggagtttgcttattcggagatgtctgccgtcggtacgttattgaaagccttgccggagtcatgtgcgttgcatctggcaaacagttcggtggtgcgctatgcgcaattatactcaattccttctacgattgaagtttgttgcaaccggggaacaaacggtattgaaggctcgctgtctacggctgtcggttatgcggcggcttccgacaaactgaactttatagctatcggagatttgagcttcttctatgatatgaatgcgttgtggaacgtcaatgttcgctccaatctgcgtgttcttctgttaaataatggaggaggagagattttccataccttgccgggattggatatgtcgggtacctcacataaatttattgcggcagttcataaaacatcggccaaaggttgggcagaagagcgtgggtttctctatctgcaagcgcaaaatgacgaagaactggctgaagcgatgaaaactttcactcaaccggaagctatggagcagcctgtgctcttggaggtgtttaccaacaaaaacaaggacgcgcgcatgttgaaaaattattatcatcaattaaaacaaaaatagattatgtcaacacaaagagagtggacaaccattagagaatacgacgatattctttttgattattataatggaattgcccgtatcacgatcaaccgtgagcgctatcggaatgcgtttactccgacaactactgctgaaatgagtgacgcattgcgcatctgccgtgaagaagcggatattgatgtgattgtgattaccggagccggtgataaggcattttgttcgggtggtgaccagaatgtgaaaggacgtggcggatatatcggaaaagacggtgtgcctcgtcttagcgtattggatgtgcaaaagcagattcgcagcatcccgaaaccggtgattgctgccgtgaacggttttgctattggtggcgggcatgtgcttcatgtggtatgtgatttgtccattgcgtcggaaaatgctattttcggtcagacaggtcctcgtgtaggtagctttgatgccggattcggtgcgtcttatctggcacgtgtggtcggtcagaagaaagcacgcgaaatctggttcctttgccggaagtataatgcacaagaagcattggatatgggattagtgaataaagtagttcccttggaacagttggaggacgaatatgtgcagtgggcagaagaaatgatgttgcttagtccgttggctttgcgcatgattaaagcaggattgaatgccgaactggatggtcaggcaggtattcaggaattggcaggtgacgcaacgttgctttattacctgactgatgaagcacaggaaggcaagaatgcgttcttggagaaacgtaaaccgaacttcaaacaatatccgaaattcccttaaaatcggctttgccacagagtaccacagagtttgcttttcctgcgtttaagcccgattttctgcaaagcaagactgtggaggagagaatggtaggagaactgcaagagatataacttgttaaaacttcgtgaggctctgtgttattctgtggtgaattgaaaaattattcacgatgaattgtaaaatagaaattattccccgattgctccatttcaagcaacctgccgggacttccagaggaacatatactacgcgtaaagtttggtatcttcattttacctctcctgacttccctggcagagtgggaataggggagtgtgcacctttgcccgctttaagttgtgacgatcttcctgattacgaagatatattagtgaaagtctgccggaaagtagagagggaacaaggcagattggatatggatggcttgtgtgactatccttcaattttatttggtctggaaacggtcatccggcatttctttgcaggaaactgggctttatgtgatacggctttctcacgtggagaagttggtattccgattaacggccttatttggatgggagattttcagaacatgttatcccagattgagaaaaagatggaagccggatttcgttgtatcaagttaaagataggtgctatcaatttcgaagaagaactgacattgttgcgccatattcgtacgcatttctcttctaaagaaatagagttgcgtgtagatgcaaatggtgctttctcacccgtggacgcaatggaaaaactgaaacgtctgtccgagtttgatttacattctatcgaacagccaatccgtgccggacaatgggaggaaatggctcggcttgctgccgaatctccattagcgattgctttggatgaagaactgataggatgcaatacgctggaaaggaaacaggagctgctttcaacaattcgtccgcaatatatcgttattaaaccttctcttcatggaggaatatgcggaggagacgaatggattaccgaagctgaaaaacaacagatcggctggtggataacttccgctctggaatcaaacattggtctgaatgccattgcccagtggtgtgcaacatttagcaatccgttgccacagggactgggaacaggggcgctctttacagacaacgtggaagtgcctcttgaaataagaaaagattgcctgtggttttgtaaatgatggtgttaaaggataatccgatgatatttgatcgaaaacaacaacgcttgttactggaaggaaaagaatatgcttttgaggatataagccgattaatagcaggaggagcggaggctcattctcctgctagttgggatttatatcttttcctgaacgaatggtttaacgattctcctgtcatcactgttcatacatcaggctctacgggtacacctaaagagttgattgtacgtaaagaccagatgatgcaaagtgcgcgtctgacttgtgagtttctggatttgaagaaaggagagacggcattactttgtatgaatcttcgttatattggtgcaatgatggtggtcgtacgttcgttggttgcaggcttgaatttgattgtacgtcctgcttccggtcatcctttagcggatataaaagagcctttgagatttgtggcaatggttcccctgcaagtttataatacgttgcaagttcccgaagagaaagagcgattgaaacagacggatattttgattataggtggtggagctattgatgaggctttagaggcggagatcaaacatcttccgactgccgcctattctacttatggcatgactgaaactttatctcatattgctcttcgtcggctgaacggaacattggcttcggaacattattatccgttttcttcagtaaaattgtctttatctgtagagaacacattggtgattgatgccccccttgtctgtgatgaaatattgcagaccaatgatatcgcacatatttatcccgatggaagttttatgattctaggtcggaaagacaatgtgataaatagtggaggaattaaaattcaggcggaggaaatggagaaattgcttcgtccttttattcctgtgccatttgttattacctcagttccggaccagcgtttagggcaggctgtaaccttattgatagtgggacagttggatacaagagagttagaaaataagttgcagacaacattggaaccatattatcgtcccaaacatatttttattacaaaatttatcccacagacggaaaacggtaaaatagaccgtgtcggatgccgcactttggcattatcacacctttcccattcacatcagttcccatccatagaactacatgatgatgtaatgtagttgggggccccggtaaaactagtgaatttgtaaatttgacttaggcttacctcccgggtgattcagcattttcatttctcatactcattctcattatttctcatagcggttgtataacggtctactgctattttacgcctgaatcattaacagtaaagttattcttcattatagataaacttgttttgggttaatagtaaacttgttttttacctattataaactataattgtaagctttgattatataattgcaagtttcatttttataaatgcaacctttgattataaaaacgaagcttgcatttatagtttatgattagtcaaaagtaactttatatataaaggattggaagtttgctattagtcaaaagcaactttactattaatatttttcagacggaaaagtaatagtttgtatgtgatgataaggagagactgttatgtgcgatagaataacaaaagtaacaatggcagatagtctttcagttcattgcgcaaaagttccattgtcttttgcttgtaacggttgatggatttcacactgagattcatctcttctgcaatttctacatgcgttttgccttcaaagaagcttttcataaatactgtacgatagttttccggaagtttgtccaatgtttcatacaacattctgtatagttcatcaagagtatatatactatccggttctgtttcgtaaattggagttttcttcttaatattttccgcatagctccattcatattcctgatgtttcaagaaattcaggcagttatttttcacacacattttaatgtaagctaatgcagtgttcgattgaagatcaaaagagtcagtatccagtttatcccataatgaagtgaatacatccgaaacgatgtcctcacgtgtttctttatcgtcaacaaaccttttggcatacaaacaaaatggggcataatattcctcataaagttgcttgaaagcccgttctttagtctgtttggaaaaagaaattttcattatttagggattctgtgttttttcattttgctacaaatatataatacaataattgattaaccctaatttcccattctttttttgtgtttcagttggtattatcgtttcattttaactgaattcggaaaaaaataaaaaaaagtttgatttctctgtcctttttaggaatcctatttgtattattaatgttgttgaacttaaaataatagcctatggaatatatatatttcaattgaataacattacgaaccttgattaacaatcttcttcttttgtttttagattcatagtccggggtctcgcaaacactgccgggaatcgaaagtgagtttatcatcagtatgaatgtggataagtgaggataattcaccgccttagtgaaacaagatgagtttgttggtaacattgaatcatttagtaataaatttattaatcaacaaaaattgaaaaacatgaaacgattgagttttttattgatggctgtagtttgtgttatattcttttcgtgtggagaagatgaagacaagcagggtcattcaattactgcatttgccggttatggtggcgccattgcaacagctgataaggaaatagccgtagcgggagaagctgtgactgttacggctactcctgctgatggatttttatttaaagaatggaaagtgagagtcggtaatactatagttgagaatgtgcaggcaaatccttccacatttactatgcctatggaggatgtagtaattgtagctacatttatgataagaaatgatgtgcttgaaagaataaccgaccctgcattgaaagcttattgtcaatccagaatggatacagagcaggaaatagacggagttacttacccgaagtgggacacgaatggtaacggtgtactttcccctgatgaagcgtcagcagtaaaagctattgatattaccggtggggtgaatggagtcaaaataaaaagtgtggatgaattggttgaatttgcaggactggaagtgttgaaagttagtggaaatgaattgactacattaaatgtagcatggcctaaacttgcacaacttgattgtagccataataaattgagcaatttgtccgtaggaaaaagtgaaaatcttaaagagttatattgtaacaataatcatttgtcctcattgaagttgaaggctatgctatatgaagatggttttatgcttcattgtggtaaccaaacaacaatagatggagaagcccggacagttgaagtgttattgtctgaggaacaaatcgctttttgggaaagtaatctgaaaaaactgaatgaaaatgtaaatgtagaagttcaaactatgcctaatactgatgtctatttaacaatgactgatgcatataaatattcgtatggcagtttgacgctaatactttcggatgatgatagtaatcgtatacaattaagtttgaaattatccgaattacaaccgggagaatattctaaagcccaaataaatagtgcatatgtgacagtaacaggcggtggcagctatagaagcttagactctgacgatcccggttcgtttattgtaaaatatgatgcggttagtgatatttatactatagagggggtattaaatttgcgggcagatgcgtcgtatccttctgttaatattgtgggatttgaatatacaggaccgttgtagtctatatcaatagagaagagaatggaaaaacatccgtagattttccttatatgtagattaaagagtctacggatgtttttttcagattattgaaaaatgattggcttttgatgtcccttttcaatgagtcgattgtactattaatatagttgcaattataaaaaaaggaagtatgaataataaagaactggaggcatcattccgcaaggcgaaagctttgggtgatgatattagagaaatggagtcgattgatgcattagctgcttatcgacagtctcaaatgaagattagagggctgaaaagaatgagactgcacaatcaactgatacgttgtgctgcatttctggccataccgttgctattggcttcattgattttgggatatttatattttgcagagtcggaagaagaaataagatacgcagaagttatttctaccatgggaacggtggtgcgttatgaacttccggaccattctgttgtctggctcaattcaggtagtaagttgcgttatcctactgttttcaaaaaagacaaccgcaatgtggaactgactggtgaggcttattttcgagtggaggcagaaccggagcgtccgttttatgtgaatacgccaaatgggttgagtgtatatgtgtatggtacgcaatttaacgtgacagcttacgaggacgataactacatagaaactgtattggagaaaggaaaagtcaatgtagtgactcccgggcaggagacgattacattgattcccggcgaacaattggtttatgacaaacaaacccgccaggtgcagaaaaataaagtggatgtttatgggaaggtggcttggaaggatggaaaattgatattccggaatgcttcgttggaagaaataatcaagcgtctggaacgtcatttcaacgtagatattgaattcaataatcatttgggaaaggagtatagctatcgggctactttcagaacggaaacattgacgcagatattagattatttagctaagtcggcaaacctgaaatggaagattttgactcccgaacaacgggaagatgatacatttacaaagacgaaaataatagtagatttatattagtaatcatctgaaaaaacaaatagcctatgatataacacatattgataatcaaaaaagggaggagggccgctaccaacggctgtcttctcccaaatctaagattcacggtacagggtctcgcaaacgctaaccggaatcaacaccttagttcatttagtaataaactttagtcagctacaaatgtatgaaaaaaaatcattcatttattgcattatgctttaaatatgctttaaatctaaaacttcctttagttatgaggattagtctaacattactttttgcagtcgtattgcaactttctgcagcaaatggctatgcccaacgtatacggggagtcatttcgatgaataatgtatctattgaacaggtactgaataagatagaggaaagttcggattatgtgttcctttataatgataaggcgattcagaagaaccgcattgtttcagtgaataataattccggcaagatacaggatattctggatgaaatattccgaggcacttctatatcttatacggtggtggataaacagattattctttccgcaaaacctttcgtacagaaaacaatggaagatgcgactattccggtaaaaggtatagtaaaggatgtgaatggcgaacctcttattggagtaaatgtaaaagtaaaaggttcaaatgtcggtacaattacagatattgacggtaattttacgattaggacgaagaaaggagatgtccttgaattttcttatgtaggatacacggttcaaaatgtaacaattacgggaaatgcgactttgaatattgtacttcaagaagacaatgcagtgcttgatgaagtcgttgtcactgcattgggtatcaagcgttcggacaaggcattgagttataatgtgcagaaattgggcgatgcacagtttatgtctgtcaaggaagccagtgtgccgaatgcgttgaacggtaaggtggcaggtgtcacaattagccaaggggcttccggtattggtgggtccacaaaggtggtgatgcgtggtagcaagtctgtaaacgcggaaggaaacaataatgcattgtatgtgttggacggtataccgcttcccgatcttttcccgcggagaggggctacctctaatgcacagtatggaggagtagacgaaggtgacggtatctccaatatcaatatggaggatattgcggaagtgactgtgttgacaggaccttcggcagctgctctctatggtggtcaggctgcgaatggagtaatcatgttgacctccaaacaaggaggactgaaagacggaaagcctcgtatttcattttcccattattccgatttctaccaaccacttctcttgccaaagttgcaaaatacgtacggaagtcgtacggatgaattttccagttgggggccgaagctggagactcctgcgaattatgatccggcagatttctttgacacgggtatgagtttctctaacagtatcggggcacagttgggaacggagaatcataaatcctatatttccctttcttcttacaatgcccgtggggtagttcataataacaacctcgaccgttacaatgtttcctataatggtacatataccattacggacaaactttctttgggagctacttttatgtatacgaacaagaaagcgcagaatatgctttcgcaaggtgactattataatccgattgtaccgatttatctgtttcctcgcggtgataatatagataagtataaatcttatgagcgttatagtgcggacagaggattcccggttcaattctggccctatggcgaccaaaagagaagcatccagaatccatattggattacacaccgcaatttcaatataaaccataatgaacgttttattattggtggaagtttgaaatatacgttcaatgaatggtttaacatcagtgcccgtttccgtacggaccgtgataacaagaagaatgaaatcaaaaattatgcttctacattgctgttgctggcttccagctcggataaaggctcgtacttgttggcaacggaaaagaatatacaggattatggagatgtgattgccaatttccagaaaacggtatcagactggggatttgtagtcaatgcgggtgccagctttaagaatgcttcattcgattatacggccaattctaacaaactagaattcggagcacctctcgccagtgtagccaataagtttacattgaacaacctgactccggaaccccaatatcaggaaggtaaaaagatgaagtcgcaagccgtattctttagtgcttctgtggattggaaaagaaaaatattccttgatgtaaccggacgtaacgaatggacttcgttgcttgccaataccaagaacaagagtttcttctatccgtcggtaggtatgtcttttgtgttgacagagttcttcaaagtgccggagaaaatattgacgttctccaagcttcgtctgtcgtatgctaaggtaggaaatgtgccgatgtcacttgccggaattactattccgtcttatccgattagtccgggcggtggtgtaagtatcaatcccgaccttcctatcgacaatttgaaatttgaaaagacacagtcgtttgaaattggtttgaatgcccgtttcctgaataacaagttaggattagacataacatattataacgctaacacctacgaccagttgtttaagttcagagcaccggaaagcagcggttatgccaatttctatgtgaatgccggtaaagtaaacaataaaggtcttgaggcttctattgatgcggatttgacattcggagatttcaattattcaccgaaacttacggtaacctacaataaaaacaaaattgtggaattggtgagaaatattcctaatccgtttaccggagccgatatgaatgtttcacatttcgacatgggaggactttcttattcattccgtaactatattgatgaaggtggttctatcggtgatatatatgtcaattcggtgaaaaaagacggaaacggatatgtatatgtgaatccgaataccttgagcatgatggtggacaatgagaatttgatttatgcgggaaataccaatccggattgttctttgggatttaacaatgcgttcagctataaagggtttacgctttccttcctgattgatgcccggattggcggaaaagtggtttctgccacacaagctgttctggattctttcggtgcatctgaacagagtgcaaaggcgcgtgacaatggtggcgtgcttgtaaacggagtgctgatggatgcagaaacttactatactcaagtgggggcaggtacaggcgtgttgtccaattatgtatatgatgctaccaatatacgtttgagggaagcttcgctttcttatcgtttcaaaccattgttcaagaactttgtgaaggatttgactctgtccgtgaccggacgtaatttgtttatgatttataataaggctccttttgacccgcaactaacctcttcagtgggtactttctatcaaggtatagactatttcatgatgccgagtttaagaagcttcggtgtgagtcttaaatttacattataattaaattaacaaacagatgaaaatgatactaaataatagatatttcggcaaaagtctgcttctggtttctgcttgttctttgtggatattaggagcttgtacaggagatttcatggagacaaataccgatcccaatgctgtgacggaagaagagctgggatatgacaacttgggtacgggctcgatgataacgcagatgcagtatcagatgtatccgtgtattacaaaagaccagaatatagatgtcaataactatcagaaaatgtttagccttgccggagatatcttttccgggcatcagggagcttccaacatgtttgatagtaacggaagaaacaatacgacgtatgatatgtatcccgactggtgtgcggcggcttatactgtggcttatcagaattatatgagtccttggtataccctttatactaaaaggaatatcaacccttccacatttgcagtgggacagattttgaaagttttcggtatgcaccgcatcacggatatgtatggtccgattccttataaggatttcgcacctgcttccgatgtgccgttcacttcacagcaagacatttacgaacagttctttagcgaactggatgaggcaatcgggatattgaaagagtttatcaaagataatcccggtgccaagccattggtaagttatgataagatttatggcggtgattttgaaaagtgggtaaagtttgccaattctttgaagttgcgcctagctcttcgtatcgtttatgtaaacgaaacgatggcccagcagaaagctgaagaggcaataagagacggtgtatttattgataatgaggataatgccatgttaaaagtggatggctctgcaacggtcaatcctttgtatatgatttgttacacttacaatgacagtcgtttgggagcaaccctggagggctatttgaaagggtatgaagatcctcgtctggatatttggtttgccaaatcggaagtttccggatttaaagaatataacggaatcagatgcggtagtatgtttaatggaaatgactataaggtattttctaatctgaatgtctcttcaagtacgcctatccagtttatgaatgctgcggaagtctattttctacgtgcggaagctgctttgcgtaaatggaatgcgggaggagacgcagaaacattatatgaaaatgggattgcgactgctttttcccaacctctgggggctacccaggcaaaagcgggagatgcaactgcgtacatgaagcggactactttgccaaaaggttatgttgaccccaaaaattccagttatagtgacagtagtacgggacaggtgtctgtgaactgggcggatgctaccaattttgatgaaagattggaaaaaatcattactcaaaagtggattgccctgttccccgacgggcaagaggcatggagcgaattcagaagaacaggatgtccgagagtgattcgggtggccagaaataatagtggcgggcgtatcgacactaaaaagcaagtggcaagattgccttatcctaccaacttgtcgaaagactatcctgatttataccaggaagctgtgaataatgccgaattgctggatggcgccgacaatggaggtacgaaactttggtgggataaaagaaatgataaaccttatcagaattaaaaaatagtgtataatcttaatagttttatatggatatgaaaaacgatcggataataaaatttctgtgttgcctgtttatggtgactcagattatcggatgcagcgattggattgaagctgaaccgactattttaccggaaatgaaatataaagaattgacaccggaagaagaggctgcattgattgcttacaagaattcggatcataagatattctttgcatggatgaattatagtcctgctacttcttccatgcagactcggttaagaggtatccctgatagccttgatattgtctcattctttaccggatatgtgaataataaacagaatcgggaggatgtgaaattccttcaagagcgcagaggtaccaaggtattattgacaatgtggccggataaatattttgctacgactggagaaggaagagaggatttagattcgatgatagtatacgctgagaatctggttgattctatttatacatggggattggatggatttgatttggattatgaaccaagtttcggcggagatagttataccacagagatgatgcgtacttttattgatgtaatgagtaaatacctgggacctaagtgtgatgagcaatataaagtgaatggtaaacataagttgttggttgttgacggacagtggaatgacgctgaatatgcagaccgttttgattattttatcggtcaggcatataatgccagttccgaatcttcactgaataacagatgtcaggatggatggcaagattatgggaaaggattcccgaatgaaaagaggatcttttgtgaatgggtgagtcaggttggcaatgcgtttggacaaggtggagtgaattatagatatgacaatgaatatattcccagtttatggggaatggctcactatgctgtcgaaagtccgaagaacgtggcaggttgcggtgcgtatgtgttacagttcggatatgctgaaggaaaccatctgaatttgcctgtaccacctaataattactattatgcacgccaggcgattcagattatgaatcctgctggtaaaacagtggaagatgaaacagacggagaagaggttgaagtcgaagaataacaattataaagttgtaaagaaatgaagaatttattcacaaaaaatagattggctgttgcgtgcctttcatgccttgcctttataggaacggcctgcaatgaaagcatagatgtggaagctgtgtatatcaccgctgctgaaaaaactcctataacgactttttctgcaacgaacaataacgatgaactaggaataacaatttccagttcgttgattgcaaattcaaatatagaaggtgaattgatgattgacaattcgttggtggaacgctataatagtgatcatggagagtcttacaaaactctgccggaaggtgcttgtgtattgtcgagcagttctgtgttggtagaaagcggcaaatatcgttccgaagcggtgaaactagtggtaaaggacatagatgccatacagaaaggcgttaatttcttgttacctgtaaaattggttagtaaaaataaggattatcctagtttgccgggaagtgatgttttatatgtcatagtcaacaggaagttacttgtgaatgttcctaaactgaatggacagaattattttaagataaactttaaggataatgatgtcagcagattccagaatatgagcgcatttactatcgaaacaagagtaagtttatgggagttccctaaatactatggtggtaatctaatgagtattataggttttcctgttggagagaatgcagagaaaggtacatggatttttgtagatggaactcctgaccgtgtgggaggtgaaggtgatgtgcctgtctttatgtttgcaacgaaagggtggtcagtgtatgctggtaagttgggatatacgctcgaaaagaatgcttggtatcatgtagccggagtatttgaaaataataccctgtctttgtacattgatggaattttgtttgtacaagcggaatatgcaaatccgatttcattgtcagataagttctacatcggagctgcaccgggagtgcaaaacggtttctatttgaaaggttctgtgagcgaagcacgtttttggacaagggcattgtctgcttccgaattgaagaatccgcttcatcgttgttttgtagaagttgacagtgaagggttggaaggctactggaagctggatgatatgagtgatgagtgtaaggattataccggacatggtcatactgctgtgaaggaaggaagtggtgctatagaatggatgactgaagtaccttgtccttgattcttctagtttatttgtaagtttgaatagaaataagaaggagatgtgattattttgacacatctccttttttaaacttaaaccttttatcttaattacttgctattataagccgtcaacatccaaaccaatttttcctgttctttcagataatcgctcatcatcgaaacggttacttcatctccggcttgagaagcgatagacaagattttacgttcttcaccaatcagataactgatactctgaaggatattgttcagtgcctgttcgccgttgctcaccttatctacttcactgatatttgctactttcaaataatcgctgaatttattggcaggagtaccgcccaacatcaagatacgttctgcaatttcgtctaccttttcggctgtgtcatcatacatcttttcgaattggctgtggagaacaaagaaatcatgtcctttgatattccagtggaaaccgcggagattggtgtaatacacttggaagtctgctaatagttgttgcaaagatgctactacgttgtttgctcccgattcattcagtttgataaattctaaagttttcatattctttttatttttaatgatttatacttgttttcttttttttctgtactgcaaagataaggcggaaaatgcttgttgtcaaactgaaaatttctatctttgcatagatgaaatctataacttaacatgatttgatagatgacgatacaacaattagaatatatattagccgtagaccagttcaggcatttcgcacgggcagccgaatattgccgtgtgacgcaacctactttgagtgccatgattcagaagctggaagatgaattgggagtaaagttattcgataggacagtgcaacccgtttgtccgacacccatcgggcagaaagtgatagaccaggctcgtgtgattctggcgcaggcagctcaagtaaaagaaatcatcagtgaagataagcaatcattatcaggcgtgttccgtttgggagtattacccactatcgctccttatttgctaccccgctttttccctcaactgatggagaaatatcccgaactggatattcgtgtcacggaaatgaaaacccaggatattcagcaagctctgcatgccggtgatttggatgcagggattattgccagtaaattagaagacacattcttgacggaagaaactctcttctatgagcaattctatgcttatgtatcacggaaagaaccctcgttcaaacatgacataatccgcacttccgatataaccggtgaacatctttggcttttggacgaaggacattgctttcgtgaccaacttgtccgtttctgtcagatggaagcggtgaaggttagtcagatggcttatcgtttgggaagcatggaaacctttatgagaatggtagaaagcggaaaaggaatcacttttattcccgaactggcagtggctcaattgacggaagaacagcgacaattagtacgtccgtttgctatcccccgaccgacgcggcaagtggtgttggcgacaaatagagattttattcgtcatagcctgctatgtgttctgaaagaggaaataaaagctgcagtcccaaaagaaatgcttactttgcagtccatacagtgtttgctataataatagaggttgagatgattcctgtcatatacccttgtatcgggtataagcgaaaagaataatttcaacagtggcaaagtggattccggagaaattcattggagtgaagtcatagctcaattcttgcttgataaaagagtttacggtagcccataaggtagaggctaatatggcgtgcaaaagtccttttttcattttatttgcttgtcttttattcaaaaatgttgcgaaggcaataataatttaggcacgtaggctttgttttcttgggttaattctctatatttgatgcatcaaccattatttatagttatgaaaaagtacattgcagaaatgattggaacgatggtgctcgttcttatgggatgcggaagtgccgtttttgccggtagtgtaaccggtacggtaggtgctggcgtgggaacagtcggtgtagctttagcatttggtctttcagtagtagcgatggcgtatgctatcggaggtatttcaggatgtcacattaatcctgctattacattaggagtgttcttaactgggcgtatgaatggaaaagatgcaggtatgtatatgattttccaggtaatcggagctattatcggctcggctattctttttgccttagtttccaccggtgctcatgacggacctacggctacaggttccaatggttttggcgatggagaaatgttgcaggcattcattgcggaagcagtatttactttcatttttgtattagtggtgctcggctctactgactcgaagaagggagcaggcaatctggcaggacttgccatcggtttgactcttgtattggtacatattgtatgtattcctatcacagggacttctgtaaacccggcacgtagtattgctccggcattattccagggaggagaagcactgtcgcagttgtggctgttcatcattgctccatttgtaggagctgcgttgagtgcggtagtttggaattatctgggagataaggaagaaaagaaataattcctttataaggataacttctttatataaaggagaagataaaagggcggcagtttcacaactaccgccctcttttgcgtaattaatatattatattaaaaaagagtgtgttttgcacgtttacattagatttataatcttagggaaactttacttcataagttttcggtccgccatataaagtgttgacacggatccttaatccttttttcccttccatccggtctttgatcttatccagtttgaaagatacatatccttcgcccaggctttgaggataatcaccttcactgttatgacggaattccagattgatatattcgtcctccgcactgtcttcgtcagcagtgggagcggtttcttctttgtcattaatcactagattcaggaaatgttttttatcttcactatgcgttccataatattggaattcaatcgttagatatttattatccttgttgatccacatataagttgtgttgatcttgtcatctccgactttttcttcgtcgttgtcatcttcacccatcgtgatgatgtctttagttaagattggattgatacctctcacctgaatattaaggtcgtatccattcacaggctcttccagctcgttgaatatcacaaaagctcgttgtccttccacccaatctttattactccatccttgcgcattgctgggatacatctttttcccgtcatccaaagtgaaataaaattccttgctatcctggctaatcatattgatggtactgacaaccagaagatcggacgggttgtcatcgtcgtccaaacatgactggagaatcggcattgtagtcataatagcaaagataaaggcaatgaatttaaatttcttcatatacttatttaagttttagattatataaaatggttcctttgtattgtgaaaatgcaatgggatagaaaatattgcatttgaatctgttaaagaaacaaaagtgataaaagagttgttctctctatgcagtatttctatctttgctgcatttataagttaaacacgtgtataagagaatggaagaattagagttgtcggaacaatgcaggctaggcaataaccaagctcgcaaagaactgtatgagcagtatgcgggacgtatgcttggcatctgtcttcgctataccggcgaccgtgatacagcccaggatctgcttcacgacggttttttaaagatattcgattccttcgacaagttcacctggaggggtgaaggctccctgcgggcctggatggaaagggtgatggtcaacacagctttgcaatatctccggaaaaatgatgtaatcaatcagtcggcaccattagaagagttgcctgaagaatatgaagaaccggacgcttctgatgtagaagctattccacagaaagtgttgatgcagtttatagaagaactacctgccggatatcgtacagtgtttaacctttatacattcgaagacaaatcgcataaagaaatcgcacaggaattaggtattaatgaaaaatcttcggcttcgcagctatttcgtgcgaagagtgtattggcaaaaagagtaaaagaatggataatgcataatggatagatagagatggaagagaaagaattgtggatgaataagttgaaggagaagctcgcggattattccgagccggtgcctgcttccggttgggaacaactggagaaagaacttatgcctcctgtggagaagaaaatatatccttatcgaaaatggatgatggctgctgcagctgttatattgttagccgtggtttcgtcggtaagtctatattttctggggacaccggctgcggatgaaatacgtcatataaagactccggcattggcatctacacccgatgcgttgccgggtgtgcaacaaccggatgtgcagggcacttccgtagaacccgtcttgcgaccagtggctcgtgaagaccgtttggcgaaaattgataagaatcttacagaacagaaaacaaatgcagatcaatctgcaatagaaaatagcaacgaacctgtaacagggaatgaaaataatcctgtgattgagaaagatcagacgctcaaaggtgagacggaacagacgaaaaatgaagcaaggcaggttgacagtgaaaatgtgggtcaggctacacagtcacaggatactaaacggccgaacaacaggccgcgtcgtccttccggcagagacaagctgcatattccggcagaaaaaagagcatctcaaaaaggaacatggtccatgggactatcggttggaaattcgggcggagcatccacagaagtcggtgccggctctcatgcttatatgtctcgtgtgaatatgctttctgtttccaacggtttgatggagatacctaacgatcagacattggtttttgaagatggagtgccttatctgcgtcaggcaaaacaagtggtcgacattaagcaccatcaaccaatttccttcggattgtccgtccgtaaaggactggccaaaggattctctctcgaaacgggattgacttacacattgctttcttcggatgcgaaactggcgggtgaagagcagcagatagaacaaaaacttcattatgtaggtattccgctgcgtgccaactggaatttccttgataaaaaactcgtcactctctacgtttccggtggaggtatggttgagaagtgtgtgtatggaaagcttggttccgagaaagaaacggtgaaacctttgcaattctcggtatctggtgcggtaggtgcacaggtgaacgcaacgaaacgtctgggtatctatgtagaacccggtgttgcttattattttgatgacggttcggatatacagaccatacgtaaagagaatccgtttaatttcaatatacaggctggtatccgcttgacttattaatgcgaactaccttactgaacatagtgacggtatccgttcaagatggcgtcactatcctgattagatagcgtcactatcttgaccggatggcgtcactatcctgatattagtatctttttcctcataaaaatcggataattgagaaaatattaataatattgtcacctgttaatggtctatggttgcatacctttgttgcaaaattctaagctatggtgaattttacagatgaaaaacatttattaatcgatttaaaagacggttcttttcaagcatttgaaagattgtataatatgtacagcggtaaactgtacaatttcattatgcggctttcttccggcaatcaatatatggctgaagaagtggtgcaatccacttttatccgtatatgggaagtacgtgagaaagtcaatacgaacgcttcatttatttcttttctttgtacgatagccaaaaatttactgatgaatatgtaccagcgtcagaccgttgaatatgtttacaatgaatatctgctgaaaagcggactagaccatgattcacagacggaagatactattgatcttcgtttcttgaacgattatatcgactcattagcggaagaattgccggcacagcgaaagaaaatctttatcttaagtaagcgtcagaactatacgaataaggaaattgctgaaatgatgggtatttctgaaagtacagtcgccacgcaattatctttggcggtgaaatttatgcgtgaacagttgatgaagcattacgataaggtaattgcgcttctgattgccttttttgttaatgaaatgtaattgtaatacacgtttttggatagtagataggatgaaaatgtatacttgtaaataagcaggaaagaagatggataagatatattataaagaactgattgaaaagtatttcgatggaaatataacggatgctgaaataaaaaagctctccgattggataaagaacgaccgccatttacagaactggtgggaagaagaattttccaaatcggatgccggcattaatccggtactgcgcgataaactatttgcccgaatcaaagaacagacgcagggaaaagaagaaacacagggaaaagagaacccaagaactattcgtatgaatccttggaaatgggctgccgccatcgttttacccatttgtattgccttcttcacctactatcttgtagattcttcccaaacagtgggagcgccctttatagtaaaagctgataaaggagataaagcaaccatcgaattgccggacggaacgaatgtcgttctcaattctgcttcgcaattaagctatctgaataacttcggagaaaatgggcgtcgtgtgcaactgaatggtgaagcctatttcaaagtagctcatgatgaaaagcgcgcctttattgtacaggtaggcgatttggaagtgaaagtactcggtacttcttttaatgtatctgcctatgaagatgctaaagacgtgacagtcgttcttttggaaggaaaagttggagtctatgcgcagaaaacatcgcatatcatgaagcccggcgacaaaatagaatataataaagccactcataagataacagccactcaagtacacccgagtgactacattgaatggacgaaaggaaatatctatttcgagaaagaatctttggagaatataatgaaaaccctttcacgcatctatgacgtagagattcgtttcgactccaataaactacctaatgaatatttcaccggaaccattccgggaggtggcatacagaatgcattgaatatcctgatgcttacttcacctttctattatgaaatggacggttcggtgattgttttgaaagagaaataagtggaactttcatagagtatctttgtttattcatcgaataacgtctatatttgtggtacactaatttgaagatgcaatgaatacattggaacgtaaattgccgatagggatacagacatttgaaaagatgcgtgcagaggggtgtttgtatgtggataaaacagccattatatatcagatagtagctactaaagtgccttattttcttagtcgtccccgtcgttttggcaaaagtctgctaatttccacttttgaagcctactttcagggtcgtaaagacctttttgaaggcttggcaattgaaaagttagagacgaagtgggagcaatatccggttctgcatcttgatttgaatgcgaagaaatatgagacggcggcagatttggtcgccatgctaaaccagtatttggagaaatgggaagccgtatatggtgatgagaagaaagaccgtagtcctgaagaacgttttggttatatcattgaacaagcctacctgaaaacaggaaaaggagttgtggtattggttgatgagtatgataaacctttgctgcaagcccttttagatgagaacctgttggatgaataccgtcgtattctgaaagccttttatggtgtactgaaaagttccgaccgctatcttcggtttatattcttgacaggagtcacaaaatttgcccaagtaagtgtgttcagtgatttgaatcaactgaatgatattagcatgaagattccatacgccaatatctgtggtattactaaaaaagaattagtatccacatttactcccgagttggagcggttggcagaagtgcaggagatgtcttttgaagatactgtcgataaaatgacggcaatgtacgatggatatcactttacatatagcgaagatggattgtttaatcccttcagtgtcctcaatgtctttgatggattaatgtttgataattactggttccagaccggtactcctacctatcttgtagacctgctgaaacaaagtgattatgatttacgtttgctgatagatggcttggaagtaggaagttccggatttgccgaataccgtgcagagacaaaaaatccccttccgatgatttaccaaagcggttatctgaccattaaaaactttgataaatcattgaacctatatacgctaggttttccgaatgatgaggtaaaatatggctttcttaaattcctgatcccctattatacacccatctcttctgatgaaacggattttaatgcagttaagtttgtccgtgaacttcagtcgggcgacgttcattcctttatggaacgtatgaaatcattctttgccgacataccttacgaattgaacacaaagaccgaacgtcattatcaggttattttttatctcgtctttaagttgatgggacaatatgtagatgcagaagtccgtagcgcaaaaggtcgtgccgatgccgtggtgaaaacgaaagaccgtatttatgtttttgagtttaaactggaaggaacagtagacgaagctttgaaacaaatagatgaaaaaggatatttgttaccttaccggacagacgggcgtgagctagtaaaagtgggagtttcctttaatgctgaagaacgtaatattggtgaatacaaagtaatataatcgtttattgagtaaaatatagaatagagccattccgaagcccactacttaggaatgttttttttgttctctgaattgaataagttaacgagagttaaagtctgataggcgattggacgagcgagtatagcagtctgtatacctatcaaacaacttaaaagttttgatatatgaagcacaaaacaacctttgaaaagctccctcaagcaaatacagggagaagtaagaactggaaaacactgcgggctatctgtctgctattgtttttatgcgtctctttcactgcttattcccaaataacggtaagtgtgaaagacatctctttgagagcctctttaaagaaaatcgagcaagtaagcaattacaaattcttctacaatgagagtctgccggagttaaaccgaaaagtatcgttaaatgtgaaagatgcaacgattgaacaaaccatgcaacaacttttaggaggaatggacttagcgtataagaaagaacaagacaatgtgattgtattgattcgcaaagcccaggacaaatcgataactaaaaaaataacaggtactgttgtcgatgaaaaaggcgaaccagtcattggtgccagtattgtgataaaaggtgagtcgcacggaacgattacagattttgatggaaagttcacattagcagacgtaccggaaaagggaatattgaccgtctcttatatcggttataaaacagttgacctttctgccgcagggcagacattcgtaaaagttgtacttcaggaagacagtaaaatgatagacgaggtcgttgttgtcggctacggagtccagtcacaaaagctagtcactacttctatcagtaaagtaaagatggaaaatatagatcagggtaatgactataatccgattaaaatgctgcaaggacgtgtagcgggtgtgaatatctcctctgcatcaggaactccgggagaagcaccgaatgttaccgttcgtggtatcggttccgttagtgggggaagctcgccgctttatgtggtcgatggtatccccagcgaaaaatatcccaacctgaatccgaatgacattgagagcatggaagttttgaaagatgcgtctgcggccgctatctatggttcgcgtgccaatgccggagttgtattgataacgaccaaatcaggtcagcaaggtaagacgaagatagaggtgtccggtcgttacggattcgcttatctggctagcgacattgaaatggccaattcgatggaatatatgaatacgatgcaagccgctattgataattacaatgtgcaaatgggagctaaccttcaattgtatgttccttctcaaattcaggaaaccaattgggtgaaagaaatatcaagaaaaaactcgaaaacaggtaccggctctatcagcatttccggtggaaatgaaaagaccaccttctttgcttctttaggcgctaatactcaagaaggatatttgaataagagcagctatgaccagtataatatgcgtgccaaattcacacataaaataaacaacctgttcaagctgaatatgaatatggcaggttcggccagccgttcagacttattggaagaaacgagtaccagcttgaaagtacttcgtacagctcgtgaggagcagccctggtattcaccttataaagaagacggaacatcttataaagtgaacgggacagatattttgcgccacaatccggtgatgctgattaatgaagaagactgggtagctaagaaatatcaactgtctggtgtgttcagtatagacgtaactcctttcaaaggatttaagtacacaccaacagtaagcgtatatggtattttggacaacacatctaaaaaattgtcggacaagcatgatgcccgtaaaaatagtagtggttggggagcattagccgaacaaaaagaccagagtttccgctatgtgatagataatatattctcttacaacaatgaatggaataaactaatctactccgtcatgttgggacattcgtttgagaaatacacttatgaacaattcggggcaaagagtgataactatgctaacggcgcatttccttcctccaactttgatttaatcaatgcaggtcctaatatttacgccggaaatattagttatacatcttatgccttagaatcctatttcggacgaatcgctttgaattgggacaataaatacatactgaatgcttctttgcgtagtgatggttcttcccgctttgcgaagaacaagagatatggttatttcccttctgcttcttttgcgtggcgtgcctccaatgaggaatttttcccaaaaaacaaatacgtcaatgatgcaaagttaagattaagctggggtatgacaggtagcatggcaggagtgagtaattatgctccgttatcactgattagtgcgggtggtgcttcttacaacggttctgccggattccagatttcgcaggatgcccgtgctttgacttgggagaaagccagccagtttaatatcggatttgatatagaaatgtttcagtctcgcctgactttaaacatagatatgttctatcaaaagactaccgacctgctgtttaagaaaccagtcaatgcaaccaccggatataccacattacagtccaatatcggctcattagagaataaaggacttgagttggctttgaatggtaaaatcttcaccggaaagtttaaatgggatttgggtggtaacatttcttttgtaaagaacaaattgctttccctcatcgaaggaaatgatatgtatattgttcccagcagcggtagtaaccttttaggaggttcgatgcatgcattgattaacggacagcctatcagtacattctatatgctaaagatggaaggtatctaccagcgtgacgacgaagtgcctgcgaaactgtatgcgaaaggagtccgtgccggtgacgtgaaatatttcgattataatgaagacggagatatatctgacgccgaccgaatgaatgtaggaaaagccattcctgatttttacggtggtattacttccaacttctcttacaaaggtttcgatttgtcattgttcggacaattttcggtaggtggtaaagtgatgtcggcatggcggggagtgaacggttccgaaggtactgaccatttaggattggcgctatccaatgtaaaagtaaatgaccgtggcgaatctgtcgagcaatactttaatgtaagcaaagaagtggccaacggatattggcgtggagagggcacaagcaacacgattcctcgtcctgtaagaataggagtacataccgggtatgattatgactataacgtgcaaacttcaacacgttatttggaagatgcttcctattttaaactgaaaactgtgactttgggttacactttgccggaatcagtcgttaagaaactccgcgtgaactcattaagagtctacgtttcggctgataatctactcactctcaccaagtattccggttatgatcccgaaacatcattttccggtagcccgggagactcaaattatggagttgacttcggattgcaacctgtattgcgaacatttatttttggtctgaatctaaacttttaaaaatatagatgtatgaaacgatactatactataatcaactatttgctatgtagcatttgccttttgtggatgacgggttgttcaggtatactggacgatatgcggcctaaagatcagatacctcaagatatgttgagcgaatccgatttggaaaagttattgaatggagtgtatgccgaaatggaagaactggtattcaaattttatatggatggtgatgtaaaaggcgagaatttcaaggcaggtcccggattttccatgaacgaccccatgttgatggctcctagttctaaagaagttttgagccagtggcagaaatgtttcacagccttgaagcaagtaaatttcttggttgaaacatacgaagcgtcatctaataaagagagtcaggttgtgaagcagacaggagggaccggatactacttcagagctttgatttattatcatctggtcactcgctggggaggagttcctatcttgcgtaagcgcacttacgacgtcgttcccatttcccccgaaaccgaagtgtggagttttataaaagaagacttagcgaaagcggaaggattactgtctgatttcaccgatcgtttttatgtgtctcttagtgcttgcgatgcgcttcatgccaaagtatgtttgtccttgaaagactatacaaatgcggcagcttatgccgacaaagtgattacaaaatcaaattttgcattgagtactacagcagttgagtatgcccaggcgtttgtctctaatagcagtagcaaagaactggtctttgcgttagccaacaagcgtagtacaagtttactattattctaccagacggtcaatgacatcgatccgacttgggattactctccttctaccgaatgttacagccatctttatgatgataccgccgtaaagtcaaaggatatacgggcaaaggcagtatttggtgcagataatagccgtattattaaattcccgaatggaagtaccggtcagtttgttaccaatgaacaaccgtcacaaaccccgattgtggttacccgtgtggcggaaatgtatctgattaaagcggaagcattgggagcagtcaatgggttggctacattaaaagaatttatgaacaaacgctacgcaaccgtcttgttgccttcaaatatgactgatatagagtttcagaatcaaatacttgatgagcgtcaccgcgagttgtatgcagaaggtcaacgatggtatgatttgaagcgaaccaaccgtttggacttgttttcttccttgaacggtagaaactatctgatgtattatcctgttccccagtcggaacgcgatttggcgggagaggaaaattaccctcaaaatgaaggctattaattatcttagaaagaacaaagtatgaagaatataagaatagtaacaacgttttttatctgcttgctgctactttcagcatgctcggatgattggaaagaaaatgcgctgacagctaaatttacttttgacaagacaacctactatgtaggcgaagaagtcagtatcacgaatgagacagtaggcggagaaggtaattatacctgccaatgggatttagggaatggagagacttcaacagaagttgctcctaaagtgacttacgaaacgaatggagcatatacagtgactttgcatgtgaaagacagtaaaggaaattatgcaatggctcataaattattgacgattgaagctgaacctctgcccgaagtcggcaatgtgaaactgaaatgggtaggtgcccacgtgttgggcgaaatacgttctacggctccggcagtcagtgatgataataatgtatatatgacttccaatgaccattatttgcggaaattctcggccactaccggtgaacaattgtgggagttcgacttatggacatcggctgacggtgattctccgtccggtaatacgcataccactccgagcattgatacggacggtactgtgtatgtaggaacaggcgacacaagtggcaaagtagggcgcgtatatgccatcaatcccgatggaacaaagaaatgggtcgttgccggagatgctgaaaaaggattttggaataaaggacaggcttcaaagcctcgtattaattatctgacttgtgcgattggagagaatcatatctatatgggtaacggcggctctacgggatctgtgcttgctgtcgataagaataccggttacagagtaggttatgtggcaaacgcagacaattccggaggtccgtcggggggagtatctgccggaatagcattggcgaacaacacattaatttgggctggtggaaagaacggcttattcggcgcgtcggcgtctgcactgaatacaggtggtaatgtgatgtgggcatggcaaatatatagttcgggaaatgataagccttcagaaaacatgaatgcttccgtagctgtggacgcaaccggcactatatacggaattgccaccttcccgagtataggaagcagtgcgtttgctattggaagcgacggggtcgagaaatggcgtacttcgttaggaaatgtaggaacactagaccaagggggtgttgtgataggcttggacggaagtatcattgtaacggtaaaacgtgctccgggtgaagccacaggaggaatcgttgcattatctcctaatggagttgttcaatggcattacggtgtgccggaagacgtcagtggatgtgcggcaatcgatcaggccggaaatattcattttggaacgcaatccggtaattattatatcattaaacccgaatcctcggaagaacagctaatcttgaaaaaagacttggctgcactgattagcgagagcgattctcctttaaaagataactgggaagcgggtatcggaaaaatctggagttcgcctacaatcggaccggatggaacgatctatattggcgttactcacacggtagatccgtcgaagagtgtcctggtagctttggaagatgaaggtataaccggatgtgcagcttcggcatggccgatgaaagggaaagacagccgccacaccagtgcacagttgggaggctcgggagagaatccgggaggcgaaccgggcggacaattgcctattacaggaaatctgaagaccgatttaaagaatttatttgatgatagttcctataaggtctggctttgtgcccatcgggcgaacacgcagaaaggtatagccgatggcataccggagaattcattaacttccatagagtatgcaatcaatgcaggagtagaaatgatcgaacttgatgcacgtcccacctctgacggaatattggtgctgatgcacgataatacgatcgacagaaccactaacggaagcggtgcggtaggagattattcttatcagcaattacagcaactctatcttaaagatgcagcagggaatctgacaaacgaacgaatccccactttagaggacgcattgaagaaaggcaaaggaaaggtttattttaacttggatatagtcaacaaaaacgttgccgtagcgacaatggtggcattacttaaaaaactcgacatggaaaacgaagtcctgctttatgtttcaaacaaccgtaattatgcatacgatttgaaagcggcgaacagcactctgttactgcatccgatggcaaaagcttcagatgatattacctattttgcttcatcttacacggacaatgtgcagatgatgcaactttccacctcggatgctcttgcgggagcgatgacggaagacattaaatccaaaggttggcttttattctccaatatcgtaggagcgaatgatacgaacatgttgtcggacaactattcggggttggtaggcatgataaacaaacgtattaatgtcgtacagactgattatgccgaattagctgccaagtatttaaaatccaaaaagtatagataatcccccaaagtatagatgataaaaatgaatatgaaaaactatctgataataggaattattttgctgtttcctttccgcttgtttgcagatgaaccggtgaaggcaatttacgcaaagattacgaatcctgataataaagaagtaaccgtagtcgcccatcgggcggattggcgctttgcacctgaaaattcgctggcagcaatagagagttctatccggttgggagccgatgtcgtggagttggacgttcagaaaaccaaagacggacagttgatccttatgcatgataagactttggatagaacgaccaccggaaaaggtaaggttgccgagtggacactggattctatccgtacactccgtctgaagaatggcgctgctttgagaaccaaacatcgtgtgcctacattagaggaagcattattgacggctaaagggcgcgttatggtaaatttggataaggcttatccgatattcgatgagattttccccattctggagaaaaccggaaccgttgaacagatcatcatgaaggggtcaaagcctgttgcagaagtgaaaaaggatttgggaaaatatttagaccggatcatatatatgccaatcgtacatttggatcgaccgggagctatgcagcaaatagatgatttcatgaaagaacttcatccggtagccttcgaattgttgttcgaatcggatacttgtcaactccccaaacaagtgaggacgaagctggaaggaaaaagtaaaatctggtataataccctttgggatacgatggcaggcggacatgatgacgacaaatcattggaaaacccggatgaaggatatggatatttgatagataaacttggagcaacgattatccagactgatcgtaccgcttatttactggaatacttgcaagcccgtaagaaacgtaatgagcataagatagacgcctttcattaatatgtaaacttcggttatgtcatttaaaatattggatttttataaaatctcttccccgctagccgggggagagactgattcagaagattcttcccgctttaagcgcatccgttgggctacatttttgtcggctactaccggatatggcatttactatgtttgtcgtcttagcatgaatgtagtgcgcaagccaattgtagaggagggagtattttccgaaacgcaattaggaatcatcggttcctgtctgttttttgtgtatgcagtgggtaagttgacgaatggttttcttgctgaccgtagtaatgttcggcgttttatgtctaccgggttattgtgttccgctttgataaatttatgtttaggtttcactagctccttttatgcttttgctttactttggggattgaacggttggtttcagtcgatgggagcagcatccggagtggtttcgctcactcggtggtacagtagtaaagaacggggaactttttacggcttttggtctgctagtcataatttgggtgaagcattaacctttatttccatagccttattagtcagttggatgggatggaggtacgggatgattggagctggcattattgggatattaggtttctttatgatgcttgtctttatgcgtgatacgccacagagtcagggattcttgttgaacaaaaattcttcatctgtggattcccattctttgtctggtaaacaaacggaagatttcaacaaagcacaaaaggctgtcttgaagaatcctgcaatttggattttggctctgtccagtgcatttatgtatattagccgctatgcggtaaatagttggggtgttttctatctggaagctcaaaagggatattctacgttggatgccagttttataatatcaatcagttctatctgtggaatcattggcacggtattttccggtatcatttccgataaaatgttttccggcagtcgtaatattccagctttagtatttgggttgatgaatgtaatagcactttgtctgtttctcttggttccgggcgtacatttttggatagacgtgttggcaatggtacttttcggtttaggtatcggagttttgatttgttttctgggtggtttgatggcagtggatattgctccccgtaatgcttcgggtgctgcattgggagtagtcggtattgccagttatatcggtgccggattgcaagacatgatgagcggtatattaatagaaggtcaaaagacggttcagaatggcgttgacgtttatgatttcacgtatatcaattggttttggattggttcagctctactttcagtgttgtttgccttgttcgtttggaatgcaaaatcaaaagaagtgaattaaagtgagtacattaggttagaatataagtctttgttttcaaggtattagtcaccattccgggaagtaagtaatgattgcttttcttcctggaatggctttatatttattacttgatttctaccagccagcgacttaaattcctactttcagcactaaactccacgccaatctttaccacttctctatggtctactttataaggaatcaaatatcctttctcatcaatctgtttgagtgcttcttcggccgttccgttcagcttaaattcaaatacatagatgtatttaggagtctttaccacagcatcagcgcgcccacgtgaactgcggacttccgcttccgtgaattgtcccatcagtttgaaaaccaaatagaaaataacctgataatgcctttcggtttggtcgttcaactcgtaaggaatatctgcgaaaaaggcttcgagacgagtaaggaaagattcgtaatcactattttccagttcatcaatgaattttccaatataaaatccttgatcgttattcttcattggagtgtagaatggaacaagaaaattgatgaatccataacgtacttcatcattgggaaaatccaatagatagttattaaatcgtctgtcgtagtctttaatcgtcaaatatccactttgataaatcagcggaataggattattaacatccattttatattctgcaaaagaagaaaccggaacttcgataccgcttaataaagtacggaggtcgtattcacttttttgcagcagttcaactaaaaatgtaggagtacctgtctgaaaccagtaactatcgaatttgcatccgtcgaaagaattgagtacgctgaagggattgaatactccttcagcaaattcgcagaaatgataaccatcataagtggcagtcattttttgaagtgtctcttcaaaagtcagttggttggcttccgacaggtttttgagttcaggtgtgaaagtatcaactaattcttgccgggtaatgccgcagaccgtagcatacggaggcttcatgctgatgtcgttcaattgattcaaatcactgaatacactgacttgtgagaactttgtcactccggtaagaaatacaaatcgcagatagcggtcggcactttttagcactccgtagaaggctttcaatgtctggcggtaatcgtcgagaagttccaaattgttgatagcttgcaaaagcggcttatcatactcatccaccaataccactacttgttgacctgtttgttcgcatgctcggcgaataacacccccgaatcgtgaagaaagggttctctcgtcaatccctttcccgtatttaagttcccattgagtcagatgattactaagaatttcatttaacttctccggtttatcatatttttctgcgttcaaatcaatatgtaaaaccggatactccttccattcagtttccattttctcaatggcaagaccttcaaacaattcttttttacctaaaaaataggattcaaatgtagacaacaacaaacttttgccaaaacggcgtggtctgcttaggaaatatggctttcccatattcgccattcgccataccaatgccgttttatccacatataaataatttttccttcggatatcctcaaaggtctgtattccaataggaagtttacgcatcaagtcatacatattcggttctttagctgttatacacatcaaaggtaatcattatttcgaaataatgatgaatgaacactttaaaaacgggatatatctgatatatatcatctttctccttatatatttgttgcttgcgtaacaaaaagattccccaaatgcggataagtggaaaaatattaataatattgtcatctgatattttacatctttgttatacttttgttcttaaaatgcgacactatgattgaattttcagatgagaaattcttattggatgaaataaaaaaaggaaataatcaagcttttgaatatctttttaagacctactatcctcgtttgcgtggctatgctattcgttttgttgaagatgaagaaacggctcgtgatattattcaagagtgcttcttgcgtttctgggagaagcgggcattgctgtcggcagtatcggtcacatctttgctttttgcgatggtgcgtaatggatgcttgaattacttgaagcatctttcgattgttgagaaacatcagattgaatatcttgcatctgttgatggagaagaacggctctactattccgatttcgcattagatgccgaacataaactgctgtatgacgagctgcaggaacagatcaacattgtcattgggcaattgcctgaacgctcccgcgagatattcctgatgagccgtttcaaaggactgaagaatcgtgaaatagcagacaaacttcaaatatcgaccacggcagttgaaaaacacattgccaaagcattgcagtgcttctctaaacacttcaaagacaagtatccggtagatatttatattataattattgcctgggttattatgaataataaataaaatggaaaagataaaccattgaaaattagggcgaaaaagcaggaaccgaaaaattcctgcttttttatttctatcggtggttgggtaaaagaaataatagttgttacatcttatagaaagtgaaattatggaagaaaagaaaaacattcgtgagttagctattcagtatttcgaaggaagaatcctgcgccaagacgagaaactactgtttgcgtatgtcgggcaaagcgaagaaaatcgtgcgacattcagacaatgggaaaaggagtggattgcatcaggcatttcagattccggaacaatcggagaatgggaaattttgcagcgcaagattcgcactcaagaagctattatcccgatgcttactgtttcaaaattccggtcatccgtatggcggcaagttgctgcggttgcggctatcgtgattctgaccataggaggcaccataggtatttggcagatttcttcctcattaaagccggagacgtattttgtatgtgaaactccttatggagagaagagcaaagtcgttctttctgatgggacagtcgtttggcttaatgcaggttccacactgaagtattcgaacaagtttaatacggccaatcgtaaagtcgaattgaacggtgagggatattttgaagtcacaaagaaggagggagctactttcatcgtacagacacatggatatgacgtagtcgtaaaaggaacgaaattcgatgtatccgcatatgcggacgatccgtttatttccaccactctgctcgaagggtcggtcgagttgaattataaggggactccggttatgatgtctcctggtgaatcaataagattgaatgtagaaaccggaaaatttgtccgtacccaagtaaatgcctcacaatcaaaagcatgggcggagaatcgtatagaatttgatcatatcacattaaaagaactagtcgcaaaactatcccggcaatatgatgtgaatattcgattggaatcggagtcgataggcgataagactttccgtatttctctgcgaaacagagaaacgataggagaggtgatgactgctttgcaggagatcatcccgataactatcgaacgtatagataaggatatatatatcagagaataatttctatttagtaacaactattattaaattaaatcaggaagaactatgaacaaccgaaagaacttattacggttacttcttttcgtttcattgagctttgttgcagtaattttaaatggtcaaacagtgagtaagacatttaaaaatgaagctttgaaaacggtattgaaagaagtggaaaaacaaactggattatctgttatttataaaacagacgaggtaaatgagaacaagatgattacggcaacatttaaaaatgcttcgataaatgatgtcttggataaaattcttgatgaaggcttgatttataaattgcagaataaaatgattgtaatttctaaaagtaaccaacaaaagcaatcaaaaagtggagagaaaaagaaaatttccggaacggttgtagacgaaaatggtactcctattattggagccagtgtccaaattaaaggtgaagcgcaaggaacaattaccgactttgatggtaaatttgttttgtcagatgtgccggaaaaatcgctattaactatttcttatatcggatatttgacaatagacattgctgttactgatgagaaactttcaaagataaccatgatagaagatagtaagttgattgacgaagttgtagtagtaggttatggaagcatgagaaagcaggatgtcactacttccattgcaagagtaggggggaaagacttgaaagacatgcctgttacaggatttgaccaggctattgttggtaaaatggctggtgttcaagtaactcagacttctggaaaacctaacagtggtgctactattcgcgtgagaggtacaggtactattacagcaggggcagagccgctatatgtggtggatggagtaccattggaaagagcttcaagtgctttggaaactgttgatatgaatgatgtggaatcgattgaaatattaaaggatgcttcttcggcagcaatttatggctcacgtggagcaaatggtgttgtaatgattactaccaaaaaaggggcgagtggaaaagcgaaagttagttataatggttctgttggttttcaaacgctttcaaaaaagatagatatgttagacgcttatgaatttgcagcatttgcacgtgacgggcataatggttcgtatttaacctcttatcctgacgctagtcctgatgaccctaatgaagtacgaaaaaaatcttacgacaagattccacctgagttatttccatatttagaaggacagaaagggctaacaaatacagattggcaagatgcattatatcgtacggctcctattacaaagcattccatttctataagtggtggtggagaaaagacaaaattctttatttctggaagctatttaaatcaatcgggtatcattgtgaattcgggttatgaaaggtttggtgctcgtctcaatttcacttataaaagtgataaagtggaattaggtgttaatttttcaccgtcttattcgatagaggacagagtggatagtgataataataaaggagtggtaattaatgcattaatgatgccacctgtatggccggtatataatgaggacggttcatataattatatgggaaacggattttggaaaataggtactgactatcagcataatgctgttttaaatcctgtcgcaatggctaatctgacaaaagatcaggtgactcatgctaatttattaggtaacttctattttcagtgggagataattaaaggtttgaagtataagttttcagctgccactaattataattatttttataatgagtattatcgttcgtccgaattgccgttacagggagagaagtattttcaatcaccatcaaaccccgtagctaaatccagtggaacgtactatttgaactggcttatagaaaatactttaaattatcaaaagaacttcaatggtcataatttaaatgctatcattggatttacagctcaaaaagatatgatgaagaagcattctgtacaagctacggattttgtgaatgatttagtgcagaatgtagccggaggaattgtttctacaggtggagcagattcacaggcatgggcattggcttctttcttggcacgggcacaatatgattataaaggaaaatatttattgagtgctgctatacgttcagatggttcgtctcgtttcgggaagaataatcgttggggatattttccgtcagtctctgttggatggcgtatcatttctgaagatttcatgagaaatcttccttgggttagtaatctgaaattacgtgctagttatggtatatccggtaactttagtattggaaattatgaacatattgctatgttgaaatataatcaatatgtattgggcacgggtgaaggtagtttagtatcaggtttgcgtccgtcgcagatttcaaatgatgatttaggatgggaaaaaactcggatgtacaatgttggattagacatcggtttatttgacgaacgattgacatttgaatttgatatgtatcaaagtaacacctacgatctattgttagacgtacctatccctcagattacgggattctcagatatgcgcaagaatattggtgaagtacgtaatcgtggtgttgaatttacgataggtacccatcacaattggagtgggttcagatgggatgcaagttttaatattgctgccaataggaacaaagttcttaaacttggccccgaagatgctccgatcatcacatctgcgggcgttagccatgcatattttaaaacagaagtaggtcagcctatcggcaattactttttgttggttcaggatggagtattcaaaaatcaggcagagctagatgcatatccacacttctcaaatgcaaaagtcggtgatttcaaatttgtagacgttgatggaaatggtgaaatggatttggatgatgaccgcgcaattgttggcaattatatgccgaagtttacatatggatttatgagttcatttgcatataaagggatagatttgtcattcaacttgcaaggtatttagggaaataaaattcttaatctacaaaggcgttatatagctaatatggagggaaatgtaaacagtatggtcattgctttagaccgttttcaatcagtggaaaatccgggtaacggacaggtgaacagagcaaaccgtaagtcaaccggtaacaattcacgcacatctacatggcatttggaagatggttcttatcttagaatgcaaaatattactttaggatatacattgcctaagaattttgtacaaaagttcggattaacatcattgagactttatttttccggtcagaatttatttacgataaccaattactccggttataatccggaagtaagtaactataattctaatggttccttgactcctggtgtggattatggatcatatccgttatctaagacttattcgtttggtttgaatgttagcttttaataaatacatgaaattatgaagaataaattattgatagtatgtgcatttttctgtttgagttcttgtgagggcttcttagatttgtcgccggaatctcagcctaatgctaaagaattttatgtaactgaaaatgattttaatagtgcggtaatggcgtgttaccagtcgcttcggaattatccgacaatcgttcttgatgtattggagtatcgttcggataatatgtttatgccaagttttacgtccggttctcaagataaatatgaaatcaaccattttcaagataacaagacaaatagtttgattgctgatatttgggagaaatcgtacagtgcaataagttgttgtaatgtgatgatagatcacattcagaatgcaacaattaatgccgacaagaaattacaatttgaggcggaagcccgtttcattcgtgcatttcattattttaatttggtgcgtctctttggtggagtgccattggttgtacatgaactttccgatggagaggccttgaagatgcctcgggagagcgtaggcaaagtttatgagcagattgaatccgatctgatatttgctttacagttacccgatacttatgataaatcagatttagggcgggtgacatctaatgcggctgaagctcttcttgcaaaaacttatctgacaaataagaaatataatgatgcaaagactcatttaaataatatcataatcacagagaaatatgatttgcttactgatataaaggatgtttttgatgtgaataatgagatgaataaagagatcttgtttgccattaaatatagtaaaacattgattgacggtggtcatggaatgtggttaagtctatcggatgtaacattgggccattttagtgacgtcctgaaaggagcctataatagtgatgatgcgcgtgcaggatttttggagtacaaaaagagtggttctgtttatttaccgatgaaatattatgatattcaggatgtatctactaaagatgttggaaatgattttatcgttttgcgatatgcagatattcttttgatgtatgcggaggtattgaacgaagaatcttttgatacggatattaactcaaagaacagcggtttttattatctgaataaagtacgtgatagagcagggctaccaaatctgacatccttggaagtaccttcacaatcagactttaaaaaagctgttttgaacgaaagatatttggaatttccattagaaggaaatcgttggttcgatttaattagaacaggaacggcaaaagaggtcataaaggccgcttatgatatagatattccggattatagattgattttcccgattcctagtgcagaagttgagaaggtgaataatcctaatatacttccacaaaatcctcaatattagaaaactcactatgttatattggaatatatagataagatagttatttatatattccgatataattgaaatggctgaaacatgataaatagaaaattagttgtttttgtgagcttttgtattctgagcattagttcatttgctcagaccagattagacagtattcgcaataaactgtttgctcctgaaaacaagaatgtattagtagcttctcatagaggtgattggcgaaatgcttgcgagaattctatagaggcaatagataatgcagtaaaaatgggggtagacattgtagaagttgatttggcaagaacgaaagatggacacttgatattaatgcatgattctaagttggaccggacaacgaccggcaaaggactggttgcagatcatacgctggcagaaattaaagcacttcaattgcgaaatggttgtcatataaaaactatttataaagtaccgaccttagaagaggcattactgtttgctaaaggtagagtgatgcttaatttggacaaagcttttgattattttgatcaggtttataccctattggagaagacaggaacgaccgatatggtaataatgaaaagcgatgctccggcagattatgtgaaaaagaactatgggaaatatctaaaaaaggtcgtctttatgccaaagattaatttggacgataaaaatgcaatgcagcgtttggatgactatttacaaataataaatcctgtggcggtagagttcaaatttgcatctgatttgaacagattaccctatgatgtaaaaaatgcgatgaaagggcgagcacgaatttggtataatactttgtggaatacccatgcaggcggtcacgatgatgattgctctttagttgatccggatgaaggttatggctatttgatagattcgctcggggcttctatattgcaaacagacagacctgcatatttaataaattatttgaaaaagaaagaattgaaaaagaaatgggaatgtattgaaaattgggattacctttccgtagagaatgaatggacaatgcaaacaagtcctaattttgatgtagaagaagtattcttgaaaggtaagcatactcctgctacaaatgaagatgggataattgtaactccctattttgcagcagtcattgatggagctacggcaaaatcggaattggagattgatggaaaaaaaacggggcgtatagcgatggaactggtcattgaggcgatacacgatttccctaaagatattgatgccaatgaagctctgaaaaggataacagagaaaatacattctttttatgttcagcatcgtttgttggaagagttggagaaaacacccggtagccgttttactgccaatggagtgatttatagttatgaaaagaatgaaatatggcaaatcggggactgtcagtgtctttttggtaatacttactcttcaaatgaaaaggaaattgacgctataatggctaatgcgcgtgcggtagtaaatgaaatagctttgttaaatggtgctacaccggatgatttattgagcaatgatccagggcgtaattttatttatcgttttctccagcagcaagctatacttcaaaacaatcctgataaaaatcaaccatattcttttccggtttttgatggttttcccattaatatgcatcaggtacgtattttctccataggaaatcatacacaaatagtcttgtcgtctgacggctatccttgtttgtttccgactttgagggaatcagaatgttatttgatgaatatcttggagaatgatcctctttgtatgcgccaatataaaagtactaaaggtattaagaagggaaactgctcctttgacgatagagcttatttaaaaatcagaatcaatagataaaaatactgaaacaatatgagaaagttattcatttttagtttgttgctcattgctatttcggggataaatgctcagaatagaaagttacgtgcgaatttgttagataaaaataatcattcggtgatggtggtttctcatcgtggtgattggagaaatgcaccggaaaattctttgcaagcaatacaaaattgtattgatatgggagttgatatggtcgaagttgacttgaagaaaacgaaagacggacatctcattgtgatgcatgatcaaacaattgatcgcacaacaacaggaaaagggaaaccggaaaattacactttggaagaattgcggcgttttcgtctaaaaaatggagcagctcacaagactactcatcttattcctactttagaagaagtcatgttattatgtaagggcaaaatattagtcaatattgataaggggtatgattattttaaagaggcttattgtattctggaaaaaacgggaacagttgaccaatgtgttatcaaagctggacttccctatgaacaagtaaaagtggagaacggggaagtattggataaagtgatttttatgccagtgataaatttaaataaggaagatgctgaaaaaataatagatagttatcagaaacatttgaaaccgatagcttatgaattagtctttgataatgatgaaaaagagactcttcgattgattcagaaagtgcgtgatagtggcgcaaggctttttgttaattctttgtggcctaaactctgtggcggccatgatgacgaccgtgcagtagaacttcatcagccggatgaaagttgggggtggataattgcccagggagccaagctaattcaaacagatcgtcctgctttattattggagtatttgcgtaacaagaaacttcacgattaaacgcacttccttcatgttgaaacaactaatcaatttttacaaggtctcttcaccgagaccttgtaacggagaaactttgtcttcatccgatgcccgccgtttgaagtttctgaaatggtctaccttcctttctgcgacttttggttacggtatgtattatgtgtgccgtcttagtctgaatgtcgtaaagaaacctattgtagatgaaggcattttttcggaaacagagttaggcatcataggttccgtattgtttttcacctatgccatcgggaaattcacgaacggtttccttgccgaccgtagtaatatcaaccgttttatgactaccggtttattggtaaccgctttggttaacctctgtctcggttttactaattcttttatcctgttcgctatcctttgggggattagcggctggtttcaatctatgggagcagcctcttgtgtagtagggctttcccgttggttcacggacaaagagcgcggttcatactatggcttttggtctgcgagccataatatcggcgaagcgttgacttttctgataatagcctcaattgtcagtgtgttgggctggcggtatggtttcttcggagccggtatagtgggattgataggagcgttgatcgtctggaagttcttccatgatactcccgaaagcatgggatttccttcggtgaatgttcccaaacagaaaaaggaaatgagtgagacagaaacggctgattttaataaagcacagcgtcaggtattgctgatgcctgccatttggatactggctctttcgagtgcttttatgtatatcagtcgttatgctatcaatagttggggcgttttttatttggaagctcaaaagggttactccaccttggatgccagttttatcatttctatttgtccggtctgtggcataatcggtactatgttttcaggtgttatttccgataagttatttggtggacgtcgcaatgttcctgcgttaattttcgggttgatgaatgtgtttgctctttgtttgtttctcttagttccgggagctcattttgggatagacgtgttggcaatggttcttttcggtttaggtatcggagttttgatctgttttctgggtggtttgatggcagtggatattgctccccgtaatgcgtcgggtgctgcattgggagtagttggtattgccagttatatcggtgccggattgcaggacgtgatgagcggtatactgatagaagggcaaaagactgttcagaatggagtagatgtttatgacttcacctatatcaattggttttggattggtgctgctttgctttcggtgttgtttgctttgctggtatggaatgcaaaatcaaaagaaatggattaaagtgagtacattaggttagaatataagtctttgttttcgaggtattagacaccattccgggaagtaagtaatgattgcttatctttctggaatggcttttttataatcaattaaatagaaagttttatggaaaattcattgaatgatgaattattgtgttcattgaaagacgaacttcgtgaagtaaccgcacaaatcaatgtgcatagtgaaaaattaatggatctgctcgaccaaaaaaaagaatcgtcagtcaactgactcgagagatgtcgcatctcacgcctgtcatcatcgagtatcggggaaatccgaagcaatatgtctctgttgtgctcgatgccatcaatctgggtaggttgacgtatgacggagtagcaaattgcgaacagacttttcgtgcgttagcaagcgttgtagatgtgataagccctaagaatgggaaaacgcttagtgtagagacgctggtgtcttatgagaagaaaaagcgtgctggagaatttgaggaaaaataatataaaataaaaagacgattgttgtatagttgaacaacaattcgtatatttgcagtatggaaaagaaacgtaagatccgtacatacggaggttactttgaggctttcatggagactttaaccgaaaaggaacaagataaaatccagtatggactactcttgttgaaaacacaagaaagactctccactaaatttgtaaaatttgttcaggacggagtttttgaacttcgtacagaatataatggtaatatataacgggtatttttcatttttgatgatggaaatattgtagtgttgtttaatggctttcaaaagaaggcgcaaaaaacaccgggtagtgaaatagataaagcattaaaaataaaggaggaatattatgcagataaacaatcatcaaatagtagattatgacgctgttcttgatgcgaaatttggagcagaaggtactcccgaacgtgcggaagcagaagaaaaagcgtatgctttctacaccgggcaaattatcgaagacgcaaggaaaaaggctaagattactcaagcagagttagcccggcgtatcggttccgaccgttcttatatttcaagagtggaaagtggtcagacagaacctaaggtttctactttctatcgcatcatgaatgcgttaggttgtaggatcgaattttcgatgtctttataagaagcgaatctttttatccataattacaaatatcggaatataattttgaaaattggaattatattcttatttttgttgcatgataagtgagtaactaatgagaatatttacagaacaagcgttaaaagaatatgcagaggagcatcccgattcaaaagttgctttgcaagaatgggttactatagtaaagaaaagtgaatgggcttgtttcgctgatataaagaagacctttaatagtgccgatagtgtaggtaaccagcattatgttttcaatgttaaagggaataattatcgcttggtagtagtggtgaagttcactgtaaagtttgtatatattcgctttattggtactcataaagaatatgataaaatagattgtgctaatatttgaaaatatgacaaagatagaaaaccaaacccagtatgaatgggctgtaaagagagtggaggatcttcttccgttagtgaaggatgatactcctttgaatgaccctaacagcatcgagttggaacttctttctaattttgttgccgattattcagaggaacacttttctttgggagaaccttcgcttgtggatgttctgaagcttcgtatgtacgaaatggggctcaatcagaaatcactatcacaactgataggagttagtccttcgcgtcttagtgactacatttccggaaaatgtgagccgacattgaaagtggctcgtgaaataagtaaaaaactgaatattgatgctagtattgtgctaggagtataacttcgattcagattaaaaaaacatggtgggaaatttgaaaaagataactgtctttttcaaatttcccaccgtttttttgaggaagaaaaaggaaaaggtgagggtaggtgagggtaaatttctaacattcgtatttttttttagaagaaaatagaagaatagaaataagaaatataaaaatgaaaagttgcaaaagtaccctcaccaaccctcacctttttgcgtgcgaaggagatgaaatcttattcatatagcctgtttgatttcacttgttccgtatcaataatgaatacagtgtatcttctcccgttttttcccttatgaaattcgaagccgtgtttggacatcacttttcctagttgggctttggttccgtgagaatattgataccccgtccgttcgcgaatcaattccgcaatttcagtgaccgtcagataatgcaccttttcgaaacgttccggtttgcggatatgtgtcaacaccagttcttcttccggtgagtggaaaatgaaatcctcgttgttctcttcaatccgtgagttttccgactgggtgaaccaatactgataccccggcttgttgagcagatacttgatttgtgcatacaactgcgcgtagtttattttgataaactccatcgagtcgacatgaaagcagagaaaacggcggttacctgtggtgtcgtgaagcacttcctggtaattgcatgtgccggcaaaagaagccgtatgaggaaagttttgcgaacgccgcgcgtatggcaggcggatgctgattactttgcgggtaaccaaatccttgaagatattcagttcccgtccgctcatcccttcaaattcatccagattgataagcattgcctgcgctattttggctagatcatccttgttgctcgggttgataagaccggtagaaagataggcgcgcaattcgggcggcagcaggttgttgataaacgtagtctttccgatgttctgtatttcgctgcaaagcaacaaaacagtgtggttcaccacatcgtcttgtgtggcggcagcgcacattcccaccagataacgttccagacattctacccaaaatttctggtgactagtatgcacgctgttggcaaggataccgatataatccgttccgtcccattcaggcagcgagtctaaatactcgcgaataggatggtaggtgatgctgaagtcggagtagatcagattctgaatcgtcttgacggtgcacgaatagcccagttcgttcatctccatccaaatgctgttttccatcatttcgtcgagaatatggaaaggttccggttgctccgtgtccgttttccttctgcgatattccatgatatgaagcacttcgttgtagcgtgtatcgtaattttctttgatatgttgctcaatctgtaacattcgcttctgcgtactattcagcttgcgggtgtcgaattcctcgttgtgtccgtaagcactcccgatcagtgcgtccatttcatccgcgggaagatcggtgaactggctcttgataaaagctgccgcctcttcctgggggacgccgtagcgattgtacatacaagccaggcaatgcaggtagttgttccggttgccggtgacgtacttttcggatttattgtgataatagttcagagtcaccattaaggaagcgtgcgaggaatggtagttgagtgccacttgttcggtgaggggattgttgtctggtgctgtcgtctttttctttttgccggatgcccttttcttcttttgagacttgaagaacatcggtggctgttccacgatgacagctgtggcatcgggattgaaataaatatccggatcgtaagagaacaggcaagtgcggctaacatcctgcccggaagtgtcgacctcaactccgcagagctgggcataaaaggaagcgattttgtgataagcagcatgatggaaatcttcaatttcctgaattgtttcgggcaatgtcccgtctgtccggcatacacgtaccacgattttcagtcccattcctttggggctgatgaaagcgatgcgggtgtgggcacacttttttgccagtgcgaggatgcgtgccaatgcttcctgtgtctgatggtcgatgtctactacgatgtatcccagatacttgacgagagttgcgtttgaacgtcctccccggtagttggctgaaaaggtgatttccggtagttctattttcttttcgttggctgctttctcgccttgttccgcgaagattcggcgcacgtcctccaccgtttcccggtatgtgccgttgctgatggccgatacgatttcttcttctgtcatttcggctatgacgcggtaaaagtcttgaaagatggtaaaatgatccatgttggtttgttctttttaatttgcggttgcaaagaaatttgtttgtaaaataatagaatggaacttttcgtttttttgattaagttcctagggttctcccaaatagcgtatgatcgttgccacttgccggggagagagaaggcggttgcgggcacgatagccttcttgttcgagttcttgcaggagcggaaggttgtagacaatccaacgacgtagtatttgtaaggctactttaaggcatacgttggggttgtaaagatgagctagttccgactttttataagtgcggatatgaaacggctgatccggataatacatgatgaatggtatttggtttatgctataaagttactgaaaattaatggcttattaaaagaataacgtcattattattcatagagtatcaggaaacttcgttggggaatccggaggatggaaaatgtgttatctttatgtcgttaacaaataaggaacgcgttcgaaatgtgtgaaatcttaaaattattttattatggcaatgacagtaacttattcagtagtgccgcgcaagaatcctgccaaaaaggatgagtcggcaaagtattacgcgcaggcacaggcttcgggagagttggattttgaagagttgtgcgagggaatcaccagccggtctacctgtacggagacagatgtgcgtgccgccatttcgggtattctttatgaggcgaagcgtgcgttgaaagcgggaagaatagtccggctgggtgatttgggcagtttgcagatcgggttgaacagtgaaggagctgtgtcggtcaaggagttttcaagttcgctgattacggctgcccatattattttccgtcccggaaagacgttggcggacatcacgaagattcttagctaccagcaggtaacgacgcgtgcggtggcccaaacgggcggtagcggcaatgaaggagaagacgatgacaaaggttccggtggtggttcagacggtggtggaagcggagaagctccggatccggcagcatgataactttaatattagatcaaatgaaagaaattgtaactaagattttggatgtaatcatgttccttgtgcctttcttcggaaaaagaaagcggaacagaattgtgagagaggtgcgcttcaatgctacccataaggaagtgtgtaatgtgaaaacaacggaaagggagaaggacgatgagaaagattagtctgattgtgattcactgctctgctacccgtgctgatcgcgacttcacggcgaaggatgtggacactgcccatcgctttcggggcttttcttgttgggggtatcattattatatccgcaagtcgggacagatagaaccgatgagggatgaagatacggtgggtgctcatgcacgcggttttaatgcgattagtttaggggtgtgctatgaaggcggactggatgaggacggaaaggcagcggatacacgtacttcctgccagaaagaatctttgcatcgcctggtgcgcgaactgttgcagcgttatccggatgcaaaggtggtcggtcatcgggacttgagtcctgacaccaattataatggaattgttgacccttgggagcggatcaaagagtgtccctgtttcgaggtgaaagcagagacatggtgatttttatcctatttattactgtggtggttaattgaccaccacagtagtgaaatactctttaaatacctccgcggctttttcaagttgttcgggggtattttcttttacgtctttcagcttgtattcctgctccatcgcttcatacttatgtacgcctaatgtatgataaggcaggatttccactcgttgcaccatcttatattttcccagagcctctcccaagcggcggatatcctcttcgaaatcgctgtatccgggcactaatacataacgcagccagaaaggtttctcgttttcttccagccatgctgccgtgcggatggtttgctcgttacttcttccggtcagtgcttgatggcgtgccggattgaactctttaatatccagcaatacaagatccgtcagtttgaaaagttcttctacttcttcgttccagataccgccgttgctgtctatgcatacatgtattcccttttctttcagttcacgcactaaagggactagtgctttggcctgaaacgtaggttctcctccggagaaagtgactcctccgcgtttcccgaaaaaaggacgttggctcatagccatgcggacgatttcttccggtggggtaggtgtgcctccttttccggctatcgtgtcggggttggcacaatacaggcagcggaaattgcatccttgaagaaaaacgacgagccgtaagcccggcccgtcgaatgttcccatactttcgtatgaatgtacgtttatcgtcatattgagtagatctgattacatacgttcgtggaagctacggctgataacttccaattgatgttcgcggctcaacttcacgaagtttacggcataaccggaaacacggatggtgagttgcggatatttttccggatgttccatggcatcgtaaagcatttcacggttcagtacgttcacgttcaggtggtgagcgcctttggtgaaatagccatccatcattgtcaccagattttctacgcgatcctcttcagtagctcccagtgatttggggacgatggagaaagtgttgctgataccgtcctgtgagtcgcggtaacgtaatttcgctacggaactcaaagaggcgatggcaccgttcttgtcacgtccgtgcatagggttggctcccggagcaaaagcgacacctttggcgcgtccgtcgggagtagcacctgtcttcttgccatacatcacgttggaagtgatggtgagcaaagataaagtaggacgggcatttttgtaaaccggaagtttcttcaattcttcgctgaagaaatagaccaggtcaacacccaggtggtctaccttgtcgttgtcattaccgaagcaagggaattcgccttgaatatcgaaaccttctgtcagaccgatgtcgttgcggcgtgcggtcactttggcatatttgatggccgacagtgaatcgagggcgatagaaagtccggctacaccataagcaaggttgatgcgtgggttggtatctacaagagccatttgggctttttcgtagtaatacttatcatgcatataatggatgatgttcatcgcttcgttgtaaacacgggcgatttctgtcaataccttcttgtagttgctcattacttcttcgaagttcagtgtgtcgctggttagtacggggatatttttcaccattaccgtaccggtgttttcgcaacgtccgccgttgatggcaagcaacagggcttttgccaggttgcaacgtgcgccgaagaattggatttgttttccgatttcctgataagatacgcagcatgcgattccgtaatcgtcagactggcgcacttcacgcatcaggtcgtcgttttcatattggatggaagaagtgtcgatagatacttttgcgcagaattctttgaatccttccggcagttccgggctccacaatacagtcaggttcggttccggtgaagggccgaggttgtagagtgtttgcagaaagcggaaagaagtctttgtcaccttggtacgtccgtcgttgaggcgtccacccagggattcggttacccatgtcgggtcgccggcgaagatgtcgttgtaagattgcatacgcaggtgacgcaccatacgcagtttgatgacaaactggtcgatcagctcctgtgcgaaagattctgtgatggttcctttgctcaattcatattccatataaatgtcgaggaacgaagagacgttacctagtgacatagcagcaccgtcttgttcttttacggcagcaaggtaagccatgtatacccattgtactgcttcttgtgcggtgtaggcaggacggctcaagtcgagtccgtagtattcgcccattactttcatgtctttcaatgccttgatttgctctgccacttcttcgcgcaggcggatgcgggcttcggtcatcggaccggtaaggttacgcaagtcttctttttttgcctcaatcagtcggtcgataccatagagagccatacggcggtagtcgccgatgatacgtccacgggcatagttgtcaggaagtccggtgaggaatcccagagaacggaacgaacggatttcttcggtatatacgtcaaatactccgtcgttgtgcgtcttgcggtagtgagtgaatatatcttttacacggtcgtccacttccacgccgttttcgtggcaggctttgctcactacgttgatacctccgaaaggcttgatggcacgtttcagaagttcgtctgtctgcagaccgacgatcagttcattttctttgtcgatatatccggctttatgagaagtgatggttgagacggtgacattatccagtgagcgtacgccgttattggctctttcttctgccagtgcttcgaggcagcggttccatacagcttttgtgcgttcggtaggtccttcgaggaaagaagcatctccataatacggagtgatgttgtgactaacgaaatctcttacgttgatttctgtgctccaaagaccgtctttaaagatcttatttaattccataaatgataaaattagaggttgtagttatccttttctttagagcgcacaaagttacaacgttttttcatataatcagcataaatatgctctattttatgcttttcaacataaaatacctagatattgctattctttggaaatgatgttcgtgatttttttttgtgaaaactcttgtaagtttaaaatatattcgtacctttgcaccgcttttaacgaaaagcacttctgataaagaagttttggagaggtggcagagtggtcgattgcggcggtcttgaaaaccgttgtactgcgaggtacccggggttcgaatccctgtctctccgcaataaacgctgaaaatcagcaaattgcaaagcaaacacccaattttacacccaagaatgtaaagttgggtgtttttgtattatttaagcctttggtattatgctttggttaccggaatgtatttttcttgcggatagtctatttcggtacattcaatcctgaaatcttgtaatcttcgtttgatgatgccgatgccactaataatgaggtcttctttaagatgactgttcgcaatgagttcttcatatctctgaaaaaagaacattcgtatcccttcaaaccgctgaatgccacaaacgcattaggattgcatggatgtccggtaaaatcgcattgtataaatgctctcattgtttcaaatattctaagagattatctaaatcttcaattggcttctccttgtaatctaagcaaccattctttagtttcttcttgaattcctccgtgtggtcttggctgttccactcttcacgttctttcagactctttgcaagtatgtcacttggatagtagcaagtgacattatgattgccagtcttatcttgcttttcccagattccttcatagatagtcttgccgggaaaatctaaatcattcaccggcatcgtatgatagctgccgcatttcgggcatttctgcggagcactgagtgccatacaattatattctatatccaaagctttgaatatatgttcacaattgtcacaaataaaaatagatgtatctctaagcataatcgattctcctttctttaatggttgtttatatttcttggaataataattcttctattgccgacaaataatgacaaatccctatctttcttcataatgctacgccttttatcgttttgcattgcaaagtaagatagggagggggacaaaagtctccgaattgtttggtcaaaatagaattttacagttaattttctccttttataattctaatagcaggttcccatccggcttctgctgccttatagagatattctgtagataattcactgttccgttcaactccgacaccttcttgatacatccaagccaaatggaacatggagtctggctctcccagttctgctgccttttgaaaccagcgggctgcttccttttcatttttttcaactcccaatccgttcagataacaattaccgatgcagaagtatggttcagtgctttcttcatttgccgccttcaagaagtaattaaaagctttgttataatcagtaggtatccctccaagaccgtgttgatagacaatgcctatattatggtaagctctcaaatatccctggctggcagctttttcataccagtatagtgcaacttttatatcttgttccacaccttcaccacgccgatagcaaacacctaattcatactgggcttcaggaactccacgctgtgcagcatcgctgaagcatgcaacggctttgtctatatcctgttcagtgcccattccatggatatagcacaggccaagctcatacttagcttccggtacttcgtccgcagctactaaaaaacgctcaaaagcttgttcatcgctttggtatattccaagaccttctttatagcatactccttcataatagaaggctttcatatgacctaaagcggttgctcctcgcaatgagtaaaatccttttttctgcttttggggcttctcgctagatagtagctccagtccttcgtttaatagcttttcagcggtactctcgttttccatatttttaagaatgataacgtattgtttttttatgtggttcgatattgttcaatgttttttgttaaatttgatatataatgtgagctatatcgaactcgtgttatattgtatagttgagcaattaagcagcaattccaaattgtgctttcaagtcacaatactttattgacacttcatcactatactcttttactttctctaaagagccgcaattcacaattttcttttcgcaaatttctcttaatataatggtgcaattctttataaaatataaatatttttcaggtatttcttcataagaggagtattcttttgcgacttcttctgtgaaatcttcgataaatggcacatatttactctttaagtcactgaatattccagaaatattatctaaagtcatttgtaactcattcatccgattgagttcatttttcatttctgctaatacattattagcctcatctttaaacttttctgattcatcatgcaacttctttaaatcttttatagatttaaaaatgtatagcataggggttacaaccaaataagcatcattaagttcatagcctaatttctctaattttttatgatgcttctctactatgttaaagttatctgatatgggaaattctctatagtctaacacttccaaaggatagtctttaatatcgcttttaattccaacttttattaaagcatcagccaatctctttaaaacagcttctttaatgaccgctttgtttttattgatttcatcgataggatgttgaatgtcttttaaaagtaattcttcatgtttagacttatagtagttaaaattctgttttgcttgggcgattcttttttgaaggatttccttttcctttttcagactattaggtgtgccagtaagtaattttcttactttttttagctgtacttcaacaaaaccatcttcaggaaattctatgtgtttagctgcgtaagctgcggctcctaaagctgcttttgctgcaataccaaaaacaataggtacaaatgcattagcagctatattggctgctcgttttgttaaattttctgcaatcataattataagctccaattagttttgttattatttgttgtttgaagtaaatttatacctaacaatttagcttgttttattacaatctcatttagcaaagtatagttactgcatgatactgctttatcaaattccaccatggatttattaaattccaatctttgctgcttaagcttatccatagcatttttagtcatttcagttgttgcgtctttaatatctttaattctttcattaaaaatatctttaattcttgcttgtctagtttctgctctggcattaaaaagatccattctatcaagagaaaacataaataacaccgatgctatacccgacatcatagttgcaagtactacagaccacggttcaccaatacctaatttgttaatgagtgcttcaattcctattccacaaatagtaattacactacctccaagaatcttgataatggcatctcccttttgtgcagtagtcatttgtttagattgttctccaaatagaattttccctgcttgtacaaaaactttaattccttctttgataagtttgagaatttgtttgaacacacccacaaaaagacttatcaatccttctatcaaggaggaaataaaacctttgacaaaatcccatacacttgttcctaaaaaagtcaacgcattattcaagacaaatttttttattcgattagaccttatttgaagtgcatctgaaatagtatgtgcatttactccttccttaagcccgttgcgaaaaatatcagagagttcaaaatacaaaggcttaataataaataggattatattcccaaccatataatcccgagattgcttcaaagcattcttagaggttttatctaaaattattttttgctgttcactccccaaattagtgatatttttccctgttgttttattgacagcgtcattaattcctgcgtttgcttttttccattcctgcatcatcctttgtttggtttctggcgtcaatcctaaatggggttctccatttcgttcacgtttttcttgatctgcaataaattcaggaattgtcatatcacctttatttcctttacctttcacacctgtaccattattgatgtaagctgctgttagggcaaagttataatctgcatttgctatattcgttatatcttcatcgcttaatgcgtaattacctttcaggcgttcatggattttagacaatggttcaatgtgatctacatgtgcttgatttcgatgtttatactcttttatatttctacgcccatccgggtgtgcctgttctttatacacatttttttttcctgtgtattcatccactgcatttattttattgtcattgttttcaaatttttcatttttatatttatccaaagattctttggcttcccaataatttctgtttcccttatattgagtccgcacatcatcgccatattcctgaaaatcctcagctgtaatttctcgtatattcttatactccatgtagccatccaacaaataagatgcttgttgggactgctcgtatgtaaacgaagaacattctgagaccaatttacttgctgttatccctttcttcctaagtttacgagttgcagagtttgcctctaaaaaaccatctataacagaagtgaatacaggtacaactagcttttctatcatatcatcttccgttttgaattctttatataaatcatcaattacagcttttgtttcttctttctcgtattgttcgatctcttgaagaacggaaacaaaatctaatggagaagcattttcaattttatgctccaattcttgttttcttaacttatccataaatgttatattgttttgatatttgatttactatcttcttcatctcctccctcacctctttcggctccatcacctccaccttctccctatgccacaacagcatctgataaaagttataactcggacgaagccagtagctgaacacactccagccatccccttgctccacttcctcttgtgaagaatgaataggtcgtgccctcacataatccacttgactgccatacacctttattttaataggtacaggagggcagtcttcatgattcacgccataacaaccttcaaaatagctttgcggattgatatatggtgagggggaaagttgttgttccgtcagccgcaagttgctgatgcgctccagtgcatagactgagggattcttgcgattcagcggctcggcaatgagataccagcgctgttcccatgtcttaagaaagcaaggaatacattcgtggtgctttactgcttgccggttgaaagagtgatagtcgaactcaaccactaccttgcggtcaatggcttcgagaatagcatgcagatgctccacaccgctgggcacatcttccaagaccaactctctgcgatgcttcatggccagttcggagagcccttgcatgtggaaagcggaaagcagatatttgtaaagcgagttgttctttatatagtcaaaattggagatgtaatacttccttgctcccgtatcatactctatgtcaatggcgaagacattggagacatactccttgtatcgtccgaatgttttgggtatgatttctccgtcatagagagaggaatattcccaatgatggttgatttccttgagcgacatcggtttgccacgcgacagaagctctatgatgtacaggcatttttcaagttttcccatagtgtttttctttattcggttacaaaataactctactcctcagacaaaaaacgtcttacctgtcacggtaaatttgcaaaaaaagcgtggcactgcaaaattacgtcttagctgaaggtcctaggaaaacccaatgaacaagatgtaagaatagcagcccacgctatagcgtgagaaccactatgctctctttgttcatttgaaaatttcctaggttttcaactataagacaagcataacgcttcttcaatttctaatatgtctcggagagagttgcttcaatccgaatacaaaaatagttattttgttgatgttttgcattatagagagcaaaatttataatttgaatcctctactttttcttggttcttctgctgattgtcgcagaccttgtcgaagtttttcccattgctctttgaaccattcgcttattggttgcctgtttattgtaagcaccaatttattattatcaaccgaacttttctcaactttgaaaacatcatttttgatttcaaatcttcgtttatgctcttcgaaatagatttttccattgcatctgatagcctctttctttgttagaagacaatctatcatatctttggtaaatccaatgactgtgcacaacttttccattttcaacatttctttgagcatcggaaaccagttgaatgccttttcaagcaaggtgttcagtcttgatatttctctgtctttggcttcaagttcttgattatgtattccttgaagattgcgtatttgtttgccgtgctgttcttgcatttgttgcatcttggcttttaattcatcaatgcctttatcacgcttggcaacttcctgacgcaatttttcattggcttgttccaaatctttcaattttccactgccgaaaagagaaccgacaccgcttgctatggcggtggctgcattggtggctgttttctttagcttgtcagtgcgtatttttgatttcacctgtttcagctcctgttcagcaagacctatctgttcttctttgtgccgttttgcagcgtctatacgttgtagttcggctttctgcttctcaatgatgaaatcgtttcgttccagatgctccttgcctgtaatggttttggattttccacgttccataaataggatgtcggatgccaaagtctgcatttccatcatatcattgtcattgagcttttggctcttgcctgtgtcatggttcatccagtcgaatacgatatgtgcatggtaattcggcttgaaccatttttcacctatttggaaactctccttgtcctctgcattaggctgtccgttcatccaatgcccctcgtctttgtgcaggaagatttgaagcggagtgataccccagcgtctttggcactcttcgccaaatttcttcacgtctgccagtgtggtgtccggtttgatgagcaacacaccctcacggatgggcgagcatcctgccactttgatgatttttccgttcctgcttttgcgctcacgctctttctcctgcatagcacggccagtcttttcctttaccatctgtttgatgttgtcgtagtgtgtttgcaggtcgggactaccgaagtccgggtttatccactgctcgttgtcggcagagagttcggacacgatgtagattttggactctccgatattgtgcatgtattcggcagtcctgcggttatgagcctcgtttgatttggtgttgcaaggtttgatatgtatgcttgattttattgccatactactattctgatttattgtttacgatagattactttgttcgctttcgcagaggggtacttaggggtgcaacccataagcggagtttccaaagagagggtcactctttgatcgggttgcatagggctgacagcccttgccgggttcttagggcagagccataagcccctcgggagagcccacaactacgaaagcgaagcgtgtagttatagtgggctataaccgaaagccgtttttctttttcggtggctggttgcgtgtcccttttacagattggacttgcctgtttctttcagtctgtttctgtaaatattcgttcaagtctttgcatccgctgtatgtctgcgaagcgtcacggatgtataagtctctgccgtattccatacggatttgttggagtgcttccatccctgcacggtcattgtcaaagaaacaatggatgcgctcgtagttccccaacggatagagagctttggaaacattggctacggaattcagcaccatataatcttgcctgtccagttcgggatatttcggacaattctccaatctcaaagtaagaaatgaaagatagtccataaatccctcgaacacataacacgtttccctcgctgttcctgattgtctgatgtgggatatttcctttggtgcgatacagcctttgaaatagcggttgcgaatttcatatccgcccgatacgttaggaaaggcgatggcgaaatagcgtttgccatgatgggtgaaatgtgtttcaaggcattctctttttgccagtgcaatgttgattcccctttcctgcaagtaggcgaacagggcaggagaagaaagcggtacaatctccagttgttggaaacttggctcggaaaatgattgcttgccaaaagaaaaagacacgggacgaatactgggtgtctgttcttcgattctttgcaggagatatggcacatggtcggaacaataaagttcctgtgccagtgcgatgatattcccacccttgccgagtgcaaaatcataccattggttacgttctgtattcaccttgaacgaggcttccgtttcttcccttagcggtgatttataccacagatttatgccctgttgtttgactggagaaaagcccaaactgtgcagataatctgctattttgatttgtttcgctgtctgtatatccataaaatgataggtttaatgataattgaattggtttatttctcttttcgctcgtacctctttatgaagtacggtctataatcacttcactttattctcgtatatatagaatacggtaataaagtgaagtggttttgccacattccgcaaccacttcgctttatccctaatatatagaccctcggaataaagtgaagtgattgtaaggtgtgggctaatagtggaagtcgggcatgaacgtgtacttcctgccgttctcctgcactatcatccgtttgttgcgaagcatgatgatgagcggtaccgccttttgatggttcagctttacacctattgacgtgtagcttttgattaaggcatcttccagctccttgtagccgtattcctttttcagtccgaaaactgcttccagcgcgatgcggtgctgctgttcggtgatatgtctgtaagggtcgaacttttcttcttccggtcttcccggcttcttggcttcgggcttgtacccctccatgagttcgggcagggcgttgtcgttgatatggaatgcgaaaggctcgaaatccattgcccgtatgtgcatggctgaaacgttgcttatatccccgttgcttttgtccttttctacaaggagtacggtttctgccttgttgttcagttcagtaccgatatgccccctcgcgttctcatcccccttgttctggtggagtatcgtgtggatatgtatctgcctgtcgtccgtccactgcattagtttggatatgatgcgtgtcgattcaccgggactgttgatgtcatataccatgtcacggataccgtctatgattacaagggctatgtcgggcgtattgtaaatagcctgctctacaattctgatacgctgttcgggcgtgtatttcctcaaagcgagaaattccagatgctcattgtccctgtcatcgggaagcccggccatccgtaaaatacgtttcatgactttcaggcaatgataagggctctgttccgtgtccacataaaggattttccgtttgtcttccggaagttccgccacatatcgcaatacggtgccgttcttcaatgcggcggctacgatagccgacacattgaacgtctttttgctcttggctttgccgatggatgcgctgaaattccccaatgtccctatgacggaaccatgtactttgagaatttcaggtgctttctcgtaacttttcgacaggctcaaacgtgaggcttgccaaaggattacggcttcttctgccgatatttccttgttgtctttcatataatccataagtacacctcccgttattttcgtcctccggttttctttccggccagttcaagggcaagttccgcatcaacgataatcttgcgccctatttgcgtaatggctttgtcaatctttccgcttttctttatacggttggcggtgggcagactgcatccgaacagtttggcaatgccaagtattccgtacacatactttctttctgtgtccgtgacggattgcggttgcgcttccgtttggttggaagcgtgcttgcttaggaatatgaactcttcgcctgtcatctgccagacgggttttaataataactcttgaagatttgtcatcgtccaatctatttagtcgttaaacaattagccctgcgcactggctgttatttctgttctcgaacgatgcaaaattaggtatggttataagtggtaaggatgtggatgatataaatctgaatctattatatctcactgaatatcagtcaataaaaataccactcaaaaattaatttgagtggtaaaagtggtaatttcgtggaatgtcaggatatatcacgaattatctgaatatgctttccatttctttggcgaatttctggttactatcactcggaaaatcggaaacgggttctttgtacttcgatctgtaatagctctcgtcaatatccagtagtttcaatatcttgtctcgccattcgtccctgtattgcttggatagtttttcgctcatcaggaatatcaggtaacacacccgtatcttttcccttgccttgatttttagtctgttcttgcaggggtgcagatttatattggcataaaaatccgatatagtaatggcttcgaactgttccccgacacaggtttcatgaatggacgaaagcgacttcatgtcaaaatattcatgctgtccctccggtgtattctgcatttcttcttgctcattttgcttgaccggttcatcctgtcgttttacttccacatcatcaggaaggtactttttcaggatttccataaaaagaaggctcaggcggtaaacatcaccggaaaggttctccatatattgaaaagcctcttttctgtcttgcttttgcagttcatagagtttgtccaattccttcttttccttgtcatattcagccttgcagcgttcatactccttctcggcttgcttctcttcctctgccgtatgttctctgtagccaatggaatcatgtctgttatatgcttcattcaagggcttgcttaatttttgtgtaactctcaactgcgcttctatatcagtgtcatatctgccagcgaagttgtagcatacacgggaaattatctcattatcaaacaatgggtgtttttcgtaaatcagtatgttcttctctatctcggttctcaggctgttgagaatcagagtatattgttctttatgtttgtcaagcaccagttcaaggatagcggcttcaaaagctgttgtatcattgtattgcttatagaaatccgtgatgaatttctgcttgtcaaaagagaaagtatggctgattataaaatcgctgtatattcgattgagttcgccatattggggaatcataatctgtatttctactgccatgtacacttagtttatggattcttatctttatcaagaaaggaagtcagttcttcctctacttcttctatacttggcagaactgattttaaattctcaggtatagccttgctcaactggtaatcgctgatacctatcggctggtcgtagcctgtcaatgcgtattgtgctacaacttcgtcttttcctttgcacagcaacaacccgatagtcttgttgtcattctctcccctcatcttgtcatccaccacattgatgtagaagttcagttgtcctgcatactccggtttgaattgggtagcctttaattccactacgatgtatgcgtgtaagggaatggaatatagaataaggtcggcaaagaaatcgttgtttcctatttgaaaatgcttctgccgggcgacaaaggcaaaaccattgcccatttccaacaaataacgggtaacgtgctttaccagttgctcttctatatccctttcgtctgccttttctttcgctcctgccaaatcgaagatatacgggtctttcaacaagtaattggcaaggtcactttgtggtgccgggagtatggctgtaaaattgtttaccttgttgttgctgatttgtctgttatataggttggtttcaatttgtattttgagaacattgctgctccagcccatttctaccgattgcttcatgtaccaatattttacacctaatggaagcgaattattgagcatgattacatgacttgcccaatttattctggcaacaggggatgccaaaaataatttttctatatcctcaatcgttatccggtaaatggcagatacagttttggcaacattctgaatttgcgcaagaggttcttgcgtaaattctaacaactgactatcagtggattgtatttgcgcagtaagttcttgcgtaaattgtccgttgtttagtttcaagacttcatctgtgacattctgtatgcttggaacagatagctttgcatccgtatcaatgaaacttcgtagcacgttcagcggatatgaccgtgcgaattggcacatataagtaaggttgcgttccgaatagccttttttttcaggataattgaatcggatagcctttgccagttgcttgatgattttgcttccccagccttgtaggttctgatgatacaggatatagttgcctattttccagtaatggaacagcatttgcgcattggctgcggtaatcaacctgacttgtgcctgttctatttccgaaccaacagcatgaacaaatgcgtcaaagtccgttctttctatatgatgttctttgttgttttccatgttttaatgtctattgttgtcgcaaatataattcaaatagcggataatctatgaaactgattgatacttttatagttggttaaacttgttcatggcgtttgccttaatatcatccgctatgtcaatgtagggtttcatggctttatagtcactatgccccgtccatttcattacgacctgtgccggaataccgagagccagcgcattgcaaatgaatgttcttcttcctgcatgggtgcttagcaatgcgtattttggggtgacttcatctatacgttcattccctttataatatgtttcccgtacaggttcgttgatttcagccagttctcccaactctttcaagtaatcgttcatcttttggttactgatgacaggcaatgccatgtggttttcaaaatggatttccttgtatttttcaagtatggctttgctgtggtcgttcagttcaataatcaggctgtctgccgttttgactgtggtaacttctatgtggtcaggtttcacatcgcttcttttcaagttacggacatccgaatatcgtaaactcgtgaagcagcaaaacaaaaagacatccctgacacgttccaaatattgtttttcttttggtatctggtaatctttcagcctgttcaattcgtcccaagtcaggaatatcacctttttagaggtagttttcaatttgggtttgaatgtatcgtatgccatgttctgatgatgtcctttcttgaagctccagcgcagaaaccatttgaggaatcccatctgtttgccgatggtactgttcctcatgtcctttttgtcacgcaggaagttcacatactcgttcaagccgaactcgttgaagtattcaaaggttgcatcttccttgaactctttgaggtggtttttcactgctgagaatttctcgtaggtggatgccgtccaattattctgattgccacactcctttacaaactcatcgaatacttcccaaaaatttatctgtgtttcttcctgctgctcttcgttggcatctttcatccgcaggttgaacgcatcctttagctgttgggtggttggcatggcttcctgtacctcaaattccttgaacacgttttgaatctcggcatagtatttcagcaagtccgcattgatttcggatgcgctttgcttcaacttgttggtgcatccgttctttacccgttgtttgtcggcatcccatttggctacgtcaatccggtagcctgttgtaaactcgatgcgttggcttgcatatatgacacgcatacggatggggacgttttccacgattggcacaccgttcttcttccggctctccaatgcaaaaatgatgttacgtttgatattcataattgggtgcgtttgaaattctacacccaaatatacacccaatattcggaatagcaaaaggcatttagaaagatttagatttactctacaccttggatagtatatgattatcagtgatttgcaattttatgatatttcttgaaagtataggttcaagagcctgtctctccgctagaaagcagctttttgctgctttctgtttttatggagagttttttctctagttggtaattgtaaggagaggtgctcgagtggttgaagaggcacgcctggaaagcgtgtatacccctaaagggtatcacgagttcgaatctcgttctctccgcatcatttttttacattttaatattaatgaacggctgttttgacttatcaaggcagccgtttgttttatattgttttcgggaattcggttattccaattcttcaataatcttctttacatctaccggttgtaatcgaccatataccttctcgccgatcatcactaccggagccagtccgcaggcgcctacacaacgcagacagtctaatgagaactttccgtccggggtagtgtcaccgacttcgatacctaatacacgtttgaactcttccagcagtttttctgaaccacgtacataacaagctgtacccatgcaaacagagatgggatgttttcctttgggagtcatggtaaagaaagtatagaaagtgacgacaccatacactttcgatacgggaattccaagtttggaagcgataatccgttgcgtttcctcgggtagatacccttgcaaatgctgtgcctcatgcaaaatattgataagttcgcccggtttgtttccatgcttgtcgcagatcgttttgatttgctctgccatgtcacaggctagtttgatatctgacataatactcttcatttaaaagttaatcaatcgctttgttgaaataatgcgtatgcaggagagtttccgatttctcacctagcggtttgccgagataatcctcgtataatgtcttgatatacggattctcgtgcgatttgcgcaaaggtttgttggcgtcttcacggtaaagtgcgttggcgcgtgcatagagtatttccgagttgccgtgatgcaaaggctgcccgccgccaccgatacagcctccggggcaagccataatttcgattacatgatattcgttatgtccgttccgtatatcttccagtagatgacgagcgttgcctagtccgtgtgcgatgcctacttttaattcaaatccgtttaggttaatggtagcacgacggacgccatttagtccgcgtacctgttcgaaatttacatttttcaaaggttctccggtatagatttcatagacagaacggagggcggcttccattacaccacctgttgttccgaaaatgacaccggcacctgtcgattcacccatcgggttgtcgaatgggctgtccagtacgagagggaacccgatattggcacgtttaattagtcgtgccagttcacgggtagagatagaataatccacatcggggataccgttcactttgaattcatcacgtgcacattcgtactttttagccagacaaggcatgatagatacgacaaccagtttttctctgggtatgcccattttctccgcccaataggatttagcaatggaaccgaacatctgttgtggggagcgggcggtggacggaatgtccagcatgtccgggaaatgatgttcgaagaagttgacccatgccggacagcaggaagtcaggataggtaatcgtacggatttatctccgttgagataacgtgtcaggcggttcagaatttcagaaccctcttccataatggtaaggtcggctgcaaaatcagtatcgaatacatagtcgaatcccagttcgcgaagtgcatacaccattttcccggttaccagagtgccgggaggaaatccgaattcttcacctagggccgcccgtacggcaggtgcggtctgcacaatcactactttgtccggattagccagatcgtcgagcagacggttggtgtagtcacgttctgttaatgcgcctacgggacagacagccacgcactgaccgcagtaagtacattcactttccgtcatcattcggtcaaaggcaggagcgatggttgtattgaatccgcgacggatggcacccaatgctccgaccgtctgtacatcattgcaaacactttcacaacggcgacagaaaatacatttatccatattacggacgatagaagcggtaatttcccgtttgcggggggacagttcaccgccattgaaaggcatttcgcgaatgttgaaacgcagtgctaacgtttggagctcgcagttgccgcatttagggcaagtgaggcagtcattggggtgatccgaaaggatcagttcagccaccactttgcgagcgttcattacgcgcagggtactggtttttactaccatgccctccgtgcaacgggtagcgcaggcaggagccaggttgcgccgtcccatcacttcaaccacacaaatacggcaggaagccggattattttttatacaggttcctttcaggtcgatatgacacagcgtaggtatattgataccgattttgatagcggcttcaagaatagtgcttccctcgggcacagtgatgaaatgaccgtctatctggagagtaatttgtttttcttccatagtaaataagattttagcagacaagaatagcattgaatttgcagcgtgccatgcacatgccgcacttgatacatttatcaggagcaatgacatgtggcttgcgcaccagcccgctgatagcatccgccggacagtttttggcgcatagatgacaaccaatgcaacgttccggactgatggtatatgttaatagtgatttacattgcttggaacgacaagtcttatcccgtacgtgttccatatattcatcgtagaagttatccaatgtggataaaacgggattcggagaggtttgtcccagtccgcagagggccgtatctttgatgacttgtcccaaagtggcaagtgtgtccaggtctttttctgtgccttttccttctgtaatcttgttcagtagttccaacagacgtttgtttccaatgcggcaaggtgtgcatttcccgcaggactcttccactgtaaaatccagataaaagcgggctacggataccatgcagtcgtcctcatccatgacaatcatccctcctgaacccatcatggaaccggccgagagaaggttgtcaaagtcaatgggagtgtccagatgtttttctgtcagacagccgcctgacggtcctcctgtttgtacagctttgaacttctttccgcctttgatgcctcctccgatttcgtagattacttcccgaagagtagttcccatcggcacttcgatcagtccgacattattaatctttccggcaagagcaaacactttggttcctttggaacgttctgtgccaatcgttgcaaaccagtcggctcctttggttagaataatgggaatattggcaagcgtttccacattatttacattggttggttttcccagataaccggattcggcagggaagggaggtttcagagtcggctctccccgttttccttccatcgaatgaataagggcagtttcttctccgcagacaaaagctccggctccatatcgtatttctatgtcgaaactgaaatctgttcctaagatatgatcccccagtaatccgtattcgcgtgcctgattgatagctgttttcagtcggttgatggctagcggatattccgcacggatatatactaatcctttggtggacccgatggaataaccgcagacacacatcgcttctacaatcgaatgtgggtcgccctccataatggaacggtccatgaatgcaccgggatctccttcgtcggcgttacaaaccacgtatttgacatccgactgttgtttgttggcaaattcccatttcagtcccgtcgggaaaccgccaccgccacgtccgcgaagtcccgaacgtttgataatatcaataacgtccgtcggctgtttgttaagcaggcaatcggccaatgcaaagtatccttcacgggcgatatattcttcaatattttcggggtcgataaaaccacagttacgcaatgcgatgcggagttgtttccggtagaaatccatgtgcttggagtcgctgacggtatgttccgttttaggatctacatacagcaaccgttcgattcttcgtcctccgatgatatgctcgttgatgatttcttccgcatcttcgggagtgacttgggtgtaaaaggtattatcggggataattttcacgataggacctttttcacagaagccgaaacagcctacggtgatgacttctactttatcggtgatttcgttctttttgatggcttttagaagattgtctgtaataccctggctggaagatgccttacagcctgtaccaccgcagatcagaatctgaagatgttgcgcaccggatgccagtccgtaacacttttcagtcaccttttcattactttcttcgcgcaatgaaagattgtgctctgctctcttcctgattgttgccaaatcatggatagataaaattttcataagtatcagaattgttagtcggttttttgcaaatataattctttgtttgaaataacagcgtagtctcgtacaaataaaattgttctttgacggaggatttaggtaaataaatctctatcttcgtatttaataggtatcaaacctaaaaaatataactgaagtatgagacgaattttacttggactatgttttctatcttttctgaacagcgcatccggacaagagattcctttgccggaaaagatgccgcagacacatccgcgggtactgactactccggcgggaaagcaggaaacatggaagctgattaaaaaagaagaatgggcgaaagatgttttcaataaattgaaggaacggacggaagtatatacgaacctgacggatgctcaaccggcgtggttgctgtctcgtttggcaatgtactggaagtctcatgccacggaagtatatgtgaaaggtgaaacgttcgaccatgcaggtggtgaaagagctccttatcccactgtgcgctacacgggaacccgtggcacagctgccacccacggtcgtcccaaattggcggatgtcgttccttatgatgatgaggacgggaatgtcactttctgcaataatgcacttcctgaccgtcctatggaaagtgtacacccatccaaaacaggccggaatattgaaagcctgaactgcgaaatcctgggaattgcccgtgatgccgctttcctttattggatgacggatgaagagaaattcgctaaacttgccgcaggggtctttgatacatatatgacaggcatttattatagaaacgtgcccatcgacctgaatcacggccatcagcaaacattggtaggattgacttctttcgaagtcatccatgaagacgcactccatatcgctgtccctttatatgattttctatataattacctaaaggccaattacccggataaaatggaaatctacgccggagcttttaagaaatgggcggataatatcattgcgaacggtgtacctcataacaactggaatttgctacaggcacggtttgttatgaatgtcggattggtattggaagacaataaagaatatgccgacggaaaaggacgtgaatattatatcgactatgtgatgaaccgttccagcatccgccagtggagtctgacgcgattggcagattatggtttcgatataaatacgggaatttgggcagaatgtccgggatatagcagtgtggtaatcaatgattatgccaattttgtgaatcagtttgatacgaatctgcaatatgatttggtgaaagcaatgcctatattgtcgaaagcggtagcaaccactcccgaatatctgtttcccaaccgtatgatttgtggctttggagatacgcatccgggatatttgagtacgaatttctttatccgtatgatacagaatgcacaggcgaacgggaagaaagaacaggaaaattatttcacggctttgctgaaatgcctgaacccggatttgggaaatgataaaacagaaaagaagaatgtgcgtgtatctgtcaattctttctttgaagataaaccgctggcgctaaatcccaaagtgcagccgggaaagatagaagattatgtttctcctttgttttatgctcccaatgtgtcatggctggtacagcgcaacggtatgcatccgcgcaacagtttgatgatttcgttgaatggcagtgaagggaaccacatgcacgctaacggcatttcgatggaactttatggaaaaggatacgtactggggccggatgcaggtatcgggcttttcctgtatagcggacttgattatgcggaatattattctcaattccccagtcataatacagtttgtgtggatggaatatcgagctatccggtgatgaaaagtaaccattcttttgatttgctttcctgtttcccggcatcagcggaaccgggcaaagcatttacgtccgttacttacagtaacctttattttcgtgaaccggaaagcagggcggatcagacccgtatgatgagtattgtcactactggggcggagacggggtattatgtcgatgtattccgcagccggaaagagaaaggaggcgataagatgcacgattacttctatcacaaccttgggcagactttgacattgacggcagcagatggcagcgacctgaatctccagcctacggaagaactcgcctttgcaggcgcacatctttacgcttattcctatttatatgataagaaagtggctgcgaccaataaggatgtcaaggcaactttcaccatagatatgaaagataaggacggcgatgatatatacatgaatctttggatgaaaggcgaaccggatcgtgaagtctttacggctttggcgccaatgaccgaagggctaagccgtacaccgaatatgccctataatataaaggagcagccgacgctgacatttgttgcccgtcagcatggagaagcttggaatcgtccttttgtctcgatatatgaaccgagtacgaaaaaggaaccgtctgctattcagtccgtctcttactttgatgcagaaggagcaggtttggaagattttgccggaatctgtgtgaaaagcaaaaacggacgtatagatcatatcttctctctatctgatgctgcacaaaccgctacttatcaaggaatgaaagtgaaagcggattatgctgttattagcaatgaatatgcaggaaaccggacgttgtttttagggaatggaacccaattggttgcacccggggtaatgattcagaccgacaatgccgctaatgtattgctcgaaaagaaagaagggaaatggtatattatttcttctgctccctgtacggttgttatcggcgataagaagataaaacccgatgctgcgtcggagcctatgttgttgcgtatctgatgtttcattggtaataaagaaaaattgtatatcttatccgtagtatggtatattatggcctaagatggaaattgttgcaataaaaaacaaaaaaagcgtgtttaaacgtttttaatactatattttttctaattttgtggctttctgtccaagtagtatataaaatggacagtaagcccttttttgtgggtaaatatttagtgggaaatatttagtgggaaataaatgatggtatatgtgatgagaaatggtcgcagggtaatagctgcgttatcatttctgttattatgttgtggtgtacatgtgcacgcacaacgggtggctgtaaagacaaatgcattgggttggctgaccgccagtccgaatgtagaagcagaatttgtattgggtagtcatgtctccttgaacatggggattgctgcgaacccaatcagtacagacaactttaaaacgactttcacgcattttcagcctgaagttcgttactggctaaatcgtccgatggtgagtcattttcttggaatcaccgctttcgtgaataattttgatatgatggtaaaagatgtgcatcacaaaggcgatgcatacgccgctggtttgacctatggatacgcatgggtgctgggcgatcattggaacatcgaagcaactgccggagtgggtgtgttgcgctaccgtcagtttaagtatgataagggtactccgaaaccgggtgcggtcaacgatagtaagaccaccattgcacctgtcaaactgggggtatcctttgtttatattattcgataacgaacattagctagtcagaaaagagaatgaaaatcaatttgaaacgtgatagattaacaggtatacttctcgtggcgatgatgttcgtcggtatgaatgtatccgcccaacggatccgcgtgcaggggcatatcacaaacccgcagggaaaaagtgttccgaatgtaaatgtgttgaatccggtcaatgacgaacgtatagaaatgtccgacgaggatggccgttacagtgtcttggttgagaaaaacggctcgttgaagtttacatgtgtcggttatgaagacaaaacagtgaaggtggcaggaaagcagattctgaatgtagtattgaaagatgccgtcatcgaactggacgaagttacaattacttccaaagtgaaggacaaagtgattccggaacctacggacatcgaaatcaaaggtaattatttccatctgaaaactcgtgtcccggtgcctaaggagatgtttaactcacatcgtcgcttggtattgcagccttccatttatgatgtgacactgaaaaagcgtctgttgatgcgtcctgttgtattcgacggggatacttataatacaacgcaaaatcgaatgtacgattatgatatggataaagatcctttgcacgattacatccgtgtgaaaactacttcttcacgcaagggggatattattgcttaccatgattctatctatatagaatatctgcaacatgactaccgtgcagatgtgcatctggcgatggaaaattaccggaatatcatttatcgtgactctttctccattgcacgcggaacggtcaacccgcttcgcttcttggagtataaattctccgctttcagcctgacggacgagaaataccttccgaaacccgtgatgcagttgcgggatacgaaaggtgaggtaaacttaaccttcctggtaggtaaagccgacctggatgataagaatccacaaaatcaggtggaactgaaccggttgaatcaggaattgcgtggtattgagacgaacccggatgcctctttgaagagttttcatattacgggggtggcttcgccggacggttcttacgcgacgaatcttcgtctggcaaaattgcgtacggataaggccctggaacgtatactggcacaactggacccggaaacacgtaaactgttggaggtgaaatcggatgcatcggttgcctcctggaaggaggtagctgaattgctgaaaaaaaactccaagccggaactggctaaagaagtagaggacttaatcaaacaatatacagctactccttaccggttgaatggggtcttgaaatcgaaacctttctacaaggaacttgcggctacttatttgcctaaattgagaaaggtgcaatatacctatggttattcaatcttccgttctttgacggacgacgagattagagaactttacagaaagaatccgaaggaactgacccgtttcgaatattaccgtatgattacgacagcaaaaactcccgacgaaagggaaaagtattgtagggaagctcttgaactttatgataactttacgtatgcagccaatgaactggcagtggcaacgatacagaaagatactccggattcacgtattctcgaaccgtttgtcagtaaatcggcaccggcggagttattgtctaatcaggctattgccttgctacacgaagggaaatatacaaaagcggattcagtcttgacattggttcccgaagaagcggtttctgaagatttgcaggccatcgttcaggcattggccggttattataatgatgctttcgaaaaggtggcggctaccagccctttcaatgaggtggtgatgctgctggcaatgaagaagaatcaggaagcatgggataagatttctaccatagatgtagagaccgcccgcgaatattatataaaagcgattgccgccaaccgcctggagaaaataggtgatgcgattatgagcattgagaaggcccttgaacttgatccttccttattggaagtagcgaaggtggacggtgatattattgacttgctgccggaagagcagaaaattaaataatgatatatacaacaagagtaaacgatgaatatcttcagaatcaacaataaatatgtagcagtggcaatcttcctgatgcttgctgttaccttacaggcacaggattatggtgcattgcaatatatgttacagaaacggcctgcaaatgaaaagttcgagagcaataaattcaatgaacatctctttttctctgccggaatagggccatacagcttgttaacaagtggagatagtcaggatggaatgggaatgaccgcccatctctttatgggaaagtggattactccggttcatggacttcggataggggtgaatttaggttatctgccgtcgagtatctacgattctaaaataaaaatgggtggcggcagcctggactatctgttgaatatgtcctccctggcatacggatacaatgcaaaccgttgttttgagttagtagggattgcaggtatagaagccggttattctaaggtgggcgacaatagcgatcgttccgaaaagtatccggatttgaaaggcggcggtcagctttattacggcgctcatctcggtttacagggaaatgtacgtctttcttctacattggatttgtttgtagaaccgcggatcggatggtataatgacggttttgcgtatacggaaagttggagaaactataaaatggctggttcggttctggtaggtctgacctatatgcctgctgctccgatgggaactaagattcatttcgatgatttcgataaaagttccttcctgaatcatatgtttatctctttatccggtggtatcagtacactgaaagttccgggaatcaagaatacgattaaaggattaggtccccagttctctgccggaatcggtaaatggttcagtccttcttccggtctgcgtttgtccgggacggttggactttcagacaccccttcgggcagtgcaagcggctactttaaacatgtcgatctgcatgcggactatctgttgaatatcaataatgttctttggggatatgatgaagacagaatatttagtctgatcggtattgccggagttaacctggcaggtacgaaaggagtggataaaaccgccaagtatgctccgggaataggagtcggtgtgcaaggaagtttccgtatcaaccgttctgtggatttatttatagaacctcgcctcaatgtgtataataagagatatgcaggaggtcgcggagtaggtggcaatacggatcagctcggagagttgaattttggtttgacttatcatacgattgaccgtgcggcacgtccgaagaacggattctcaagcaatcacatcgcagacaatctgtttatgacttcgggaatcggtgtgcaaatgttcctgaataagacgaatcttgaaaaccttggttctttaggtccgcaggcttctgtctctatcggtaagtggttgagcccttattccggtttgcgcctggtgggtacgggtggattctttacgaactatgtagttccgggaagtgttaaagcgggcaaacttagacatgccagcgtcagtggtggtcttgattacttgtggaacataacgtctaccatgagtggatataattccgatcgtatctttgatttaataggttcggtaggtgtcaaccttgcttatacttccaaatcagaccataagttccaactgggtattaatgcaggcatacagggattatggcatgtgaatgattttctcggtttgtacattgaaccgcagattcgcttgtatggagataaattcattgaaggtaatctgggctttatgcagaaagacgtaatggtaggagtcaatgcaggtttccactatcgctttgttccttattcaaaagcagccaatcgcagcgtgtttggtcaggatgacaagcgttacttcatctccggtgcacttggattgggtagcttgctcgtagccaacaaagatttggtgaagaatgcaggtgtagaagcaaaaggaagcataggtaaatggtacactccgttatctgcatggcgggtaaatggaacaattatgtacaaggccaaaacgtcgtcgaagatgaatcttcattatgccggtttgggtatggattatatgatgagtctggccacattggcaaaaggatacagccccgaccatgtgatagatgttgttccttttgtgggagttacggccggactggtacgccgttacggtaagttccgagcagtgccgggactggatgccggtgtgcaggtaaagctgaaagtggcttcttctttgtatctgtatgccgaacctaaagtcggtatccgtaccgatacatacgatggctccgaacagggaagacctgaccgcgtagcttccatggtaggtggattattgtacagattcaagatgcctactttccaataagaagaaaaataagaaatcgaataaaaagggttgcgcaataccggattagtgattgtgcaaccctttttgtattccatttccaagaaattacggttacataaacgttacattaatattacttccatttctacctgataatgaataaaatgaatctttagaattcattttctcccttgctattctcctctacttttgctccagaaattaaaacgaaaacgtatgaaaacgattactgaagcaatatcgaaacaaagttcaaacagaagattagccgatttcctctttattctatgggcaggtggagcagcccttctttcttactcactggtttatgcattgcgtaaacctttcacagctgctacttttgacgggatagaagcattcggttttgattataaagtactggttactatcattcagatagcaggttatctgatagccaagtttataggtatcaagttgatttccgaattgaagagagagaatcgcctgaagtttatactcgtttccattgccgtagcggaattgtcattggttgcgttcggagcacttcccactccttataatatgtttgccatgttcttcaatggattgtcattgggctgtatgtggggagttattttcagttttatcgaaggtcgccgcactacggatattttggccagtcttttaggaatcagtattgttatcagttcgggaacggcaaaatccatcggattgttcgttatgaatacattgaacgtcagcgaattttggatgccggcacttatcggtgcttttgcacttcctttattggctcttttgggatatagcttaacccgtttgccacaacctacggcacaagatatagaacaaaaaagtagtcgtgtaactctgaatggcaagcaacggaaagaactgttcatcgactttatgccatttcttgtattattgtttgtagctaacctaatgttggtagtgcttagagatattaaggaagatttcctggtgaagattattgatatgaacggacagtcctcatggatgtttgcgcaggtagatacagtcgttacattaataattctggcgttattcggagcgatggcctttgtgaaaagtaacataaaagttttggttgccctgctgggattggtcgtacttgggacagccaccatgagttttatatctttcaattatgattctctgcaattggatgcaatcacctggctgtttgtccaaagtctctgtctgtatattgcctacctctgttttcaaagcatttttttcgaccgcttcatcgcttgtttcaagataaaaggaaatgtcggtttcttcattgtgaccattgattttatcggatatacgggaactgtacttgtcttgatgttcaaagaatttgcccatgcagacataaactggttggaattttataatatattatccggttacgtaggactgatctgtacggttgctttcacctgctccatgatttacctgatacagcgctataaaaaagagaaacaactgaagaaagcgaaagaagccgaaatgagcaacgggataaaatttacgggagaaggtatggagccaactactttttcacaaatttgataaaaggtggacgatgaaaataataggactatatttgaaattctccttccttctatctctaatactaacgacttcccggataacggcacagaatctgcccgatggcatacaatataaaatcaccgggcgtctattaatggatggaggagtgtatctgaagaatccgaataactttggcaacggcacggaatttaatgaccttcgcatcggtgtaaaagctacctatcagaactggggaatgaaactggaaatgggatatgccggaaacaaagtagccatcaaagatgcttttgccacctattcctataagaatagttccattcagataggacaattctatgagccattcagtctcgatatgatttgtagtacatttgatcttcgcttcaaccaatctccgggagctgtgctggcattgacaaatagccgacgtatgggagtagcctattcctatcgtacccaatattactatctgtgtggcggattctttaccgataatgatttgagcaacctgaaaaacgcatcgcaaggatatgccattgacggacgtttggtttaccgtccactttatgagcaagcgaaactggtacatataggattagcagctatccatcgtacaccggacggcacgcttcccgaagatgagaacaggaatacgtttacttataaatctccgggcgtgagcacgattgataatcgtacattaatacaagcagatgtagatcatgcagcatcccaatttaaaataggaaccgaactgctaatttactatcataaattctttcttcagggtgaatacatccgcgcccatgtaaaacgggaaaagggttttgagaactatacggcacaaggagcttatctgcaatgttcctggctattgttgggacagaattatctgtatgacgaagaagtagcctgtcccggaagaccggaaggaaaagcactcgaactatgtgcccgtttcaattatctctctctgaatgatgccggaataaaaggcggaacacagaaagacctctccttcggattgaattactatatcaataaacacattgctgtcaaattgaattatagctacttcatccccggctcgcatatcaaagagatcgaaagcacaaactttagtgtagtacagggacgttttcaattcatattctagtacttggcagttccgttcgaataaagctataataaagaataggaaggtgtattgtatactagttttactaaatgtttcaaagacatatcgagagcactgccgactcaatatgcagaaccgtatgtaaaaagtaaaaaataagaagacagaaaaaactggaatgttctaggtaaatctcctttattgttcgtaatagacaataaaggagattttttgcattggttattttttctatagtttctgttaccagtttgccaacctgggtggaatagaaagtatagttttagaaagaacttcaataaacagaataattaaaatataacatagtttagtgatatgaatatagtaggagttttatcaggtaaaagaaaatgtttgttagcaatagctattgcattttcgacattcgggaatgcccaattagtaacctatccggaaggattgaacactggtatgccacataatgatgattatacagtcaaagtacgtgaagcaggtggtgaatggaaagatgtattcgaatatgaagtccaagtagatatggatcgggtacaatctgcttcaatggtacagtttgatataggcagtcccgtagaagtgatggtgaaaaagaacaatggcaccattcaggatgtgaaaatccgtccgttagcaataggtatacaacatacggtaaaccacaatgctatcttttttacactcactagacctcaatgcctgtcgattgagtttaacggtgatcgtttgcataatcttcatttgtttgctaatcctttggaaacagaaacttatactgaaagcagtgacaaagtaatgtatttcggaccgggtgtccatcgtccgaaagatttgccgaacacacagatacagattccttccaatactactgtttatttagctcccggagctgttgtaaaagctaaattattgattgacaaagctgaaaatgtacgcattgtcgggcgtggtattctcgaccatccgatccgtggaatagaagttacccattctaaaaatatatggattgacggtattacagttataaatccagatcactatacagtatttggtggtgagtctacagggttgaccatcaataatttaaagtcttttagttgtaaaggatggagtgatggcatagatctgatgtgttgcagtgacgtattaatagacaatgtttttatgcggaacagtgatgattgtattgccatctatgcccatcgctggaactattacggaggaagtcgtaacgtgactttacagaattcaatcctttgggcggatattgctcatccgatcaacattggaggacacggtaacccggacgataaggttggagagattcttgagaatataactgtccgtaatgtcgatattctggaacatgatgaagatgatcttctttatcagggctgtatggcagtggattgcggtgataaaaacttggtacgcaaagtattatttgaggatatccgtgtagagaatatccaggagggaagattgtttcatattaatgttcgtttcaattcaaagtatgataagcaacccggccggggaattgaagatattatttttcggaatatcatttataatggagtaggggagaatccatctctattgaaagggtttgataaagaacgttccgtcaagaatatcatcttcgataatgtgattatcaacggcatgaagatgaaaaatatagatgattttatcacgaatgaatacataaagaatatcacagtcaaatagcataatctggtatatgaagtatgaatggaaaaatctctttgtattaggtgcaaacttcttttcttctaatatcaaactttctttaggttaaacataaactataaatgcaagtttcatttatataattagaacttgcaattatataaatgaaactttcgtttttataatcaaagcttgcaattatagatttctattagataagagtaactttagtattagaaggaaagaactttgcaataggaagataataacttatctattaatagatgagagcaaagctgcactggaatcagaattaaggagtctggaagagaaccatgagtataaatacaagagttttattcccgggtttatgctaatcaaagtaaatgtttcattcactttgaactcctttttattactaaatactatctttgcttatcacttgtataaaaaacgaatcgcactatgattaacaaaattatatggattattgggattgtatggattgggaatattcaaaatggagtgcaagcgcaacgacgtaactttatccatcccggaatcacctatacccaaggtgatttagaccggatgaaagctatggtcaaggcgaaacatgagccttattattctacttttctgaaattaaaggaatctccctattcttcactcaatacgcaagttatcaatcggggaaaacaaatcagagaaggacgttttaatgctactatcggagtagatggcaggcgggcacatgacttagcattgctttggcatctgacgggcgatgaggcttatgcccgtaaagcggtcgaatatctgaatgctaattcttattataccaatacaagtagtcgtggaacaggaccattagataacggaaagatttaccttttaattgatgccgccgaattaatgcgtgattattccggttggaaagtagaagaccagcaacgttttaaaaatatgttggtctatcctggatatagcaatacggaagatttctcttccaaatatgcaaattactgggatgattcaaagaacggagttacattctattggaatatttttaatttcgatgccgcaaggtttggtaatcaaggacttttcgctgctcgtggaatgatggcaatggggatttacttagataacgaagtaatgtatgaccgtgcttaccgttatttattgggaatgaagcatcgaccggatgatttaccttatccttcaggaccgacggtcactagcaaagaaccgattaagaaatcaccaaccatgcttgattataaattggaaggaagagaaaacaagatttcagattatggatacgatgaacagctacagtattatatctatccaaacggtcaatgtcaggagtcgagtcgcgaccagggacatgtattggcaggtatccacaattatgtagctatcgcagaaatggcatggaatcagggagattctttgtataattgtctcaataaccgtttgcttcttggtttggaatggaactatcgttataacctctctaaagtccagacctatgaagagcaaaaagagccttgggaaccgacaagttatagtaagaattcaaatgaagttacctttgagaacggaaaatttctccagataaaaagccgtagtggacgttgggaatccgtagccgtatctcctcacggacgtggagacgtagcaggtagtggcggaactcgtgaaatggcattggcgcattatgcagtacgtgctggattgccggagaacaactatacctggttgaaacgttaccgtgattatatgatagaacatcacggttgcgaaaactgggggatagcacccaactggttttatgaatggactggctggggaacattgaccaagcgattgactccctggatggcaggcgatcccgtttctttctctacgggaaagcgtgtatcaggaattcatttgctaccttgtgaaatatcggctgccgattacgattattattgtcttgcggaagatcccgaagggcatacctatcacaatgtaggaaagaaacgtggcaacgaatacagacctgacggagcagtagagctacgaaaagaagaagataattacgtcgttacccaaatagaagatggagaatggatgaattatactgtaagtattcctaccgatggagattataccgtttatcttgtttatcaatcaaaaggaaattctttattgtccgtagcttctgattcagaagtaaagacagaacccatgcaattacccagttctatacaatggacggaaagagaaataggaaaactcactcttcccgcaggagcttgtgtacttcgtttacagatagagcaagccggagataaactcgaaattcagaaaataatagtaaagtaggataaggggatttgattcttcgttcgtacttaataatagtactacaaaaaaagatggccatgaaaattcgaatatgtttgttaatcatactaatgggattattgtatccgggttatattagctcgcaagaatccccttatgtattccgccagattggagttgtcgaaggattaccggataactatgtaaaaagcgttttccccattcccgacggacgtatcggtgtgcgaagtactgtgttattaagcctgtatgatggtgcgaactattcaaatttccctttcaatattcatggcgaatattcgatagcatataaccatattattcccgaacaatatattgatgccgacaaacgtttgtggatgaaagaacgcaagagcctacgcgtcttcgatttgactaccgaacagtacatctataacgtagattctttatttcaacaattcggcttaaaggataaagtggcggacctgattattgattcagagaaacattgttggtttctgacgccgggttcctctgtctatatgtacgatgcagagacaaagtcaatcgaacaggtttgcaggaatgatgagtttatggaatactatggaggattactcggagtagaaagtcatggaaaatacagttggatggttcatcagaaaggggctatccgttgctacgatttggaaaagaaacgtttcgtgcatcaacttgatttcctgaaagaccaactgaaaccggatgaccgtgtggttttgaagatactcgataatggtgacttttggttgatgtgggatcgtggagtaggctattatgatgtctataataaaaaatggaaccaaatttcaggtatccaactcggacactattcatggtttacttctatggatgtggataaaggtggaaatgcatgggtaggaaccgttattgatggattctatatcattgatatgcacaatttctctgtaacccggacactggatattcctttattatcaggtaatacagtacgaaacggtattcaaagcatctattgcgaccgggaaaataattccgtttggataggactttataatcagggaatgtgttattatcatcccagcatgaataaaatagtgctgtacaataagaagatgataaatggcgactggaaaggagaggaaatccgttgtatgctcgaaacatctaaaggagaaattctgatgggtactacgcagggtgtctatcgctatgaaccggagactaaaagcatgaacagattctatcatgaattcagtcagaagaattgccgtgtactttatgaggatagcaagaagcgtgtttgggtcggaacataccacgatgggctctactgcatagatcatggaaaggtacaatcttacgattatcccgatacggattatcagaatgaattggatttcagtaatatccgtgtcatggtcgaagattcttccggtcgattgtgggtaagtatatatgggggtgtaggattatttaatcctgaaaacgggcaaataaacttattgtccgaacagtttcccgaactcaaaaaatacaaagtagcgaatgcattggccatagataatcaatcccggttggtcgtaggcagtgataacggactctacatttacgatcctgcaacgaataaaatatggataccggaggaagatggccaggctaattctatattcaatcagggaagtatcaagtataatcagatactcaaagaccatgagggaactttatggtttgctacacaatatggcttgagcgttttgacttacaatgggcaaagctacacattagggaaagaagaaggtctgtctaaagctatcctgaacgtagtggaagataagaaccatgatatatggatttcgacagtcacttctatttataagataaaagtagacagaagagcagataaatacagctttcatgtaatcagctgtctgtcggaagatgaaatccgtcaggatgatttatatagtttcccttcgttaatgaccagggacaatcagcttttcctggggctgatgaacggctttatcgctttctcaccagaaaacatgatagataatcagtgcctcaatcgtcctctgtttacctcattccgcttgtttaatgttccggttgtttcgggcgaaacatataacggacgtgtcttatttgataaagcattaagttattcgggcgaagtacaattaaaatatgatgagaactatattacacttgagttctccggtctgaacttccctaatccttctcaaacctctttccgttaccaactggaaggatttgacaaagaatggacggaaaccctttttgagaatggacaaggacgtgtggtctataataatctcccttcgggcgaatacattttccgtgtgtccgctgccggaaacgaccggatatggagaccggagtctgcattcaaaattgtaattcatcccccgttctgggatacactggccgctcgttttttctatgcaattttagttattctcttaatcttcgggttgatctacgtaataaaccgccgcaaccggcagaagatgattcgtatgcaagaagaggaagcgttgaagcagaaagaagaactggatcagatgaaattccgcttcttcacaaatataagccatgaactccgcactccgctgacattgattatcacgccattagacatggtgatacgtcgattgacagacgatgcgatgaaaaaacaactgaataccatctataagaatgctcaaaacctattgtcattggtgaatcagctactcgatttccgcaaactggaaatgaaaggagagaggttgcatctgatgaacggcgatatggaggaatttattgtttctgcctataacaacttcatgccaatggcagtagagaagcaccttaactttgtgaaccaatcggaacatagagcgctttatatgttcttcgaccgggataaggtacataagattgtgaataatcttttgtccaatgccttcaaatatacgccggaaggcgggacggtcgacttactgcttgcaacagaagaaatagaaggaagaaactacgtgagaatatccgtatccgacactggaatcggaatatccgaatcagaccttccttatatcttcgaccgtttctatcaggtaggaaatgaaggagacgaaaaaataggtagtggcatcggacttcatttggtaagggaatatgtaaatatacatggtggccgtattaaagtggacagccggatagatcgtggatcagtattcaccgtttggttgccgatggacctgaaaccggaaccggacgaactgccggaagaaatcatcggaacggaagcatcagatgttaaagagaaagaaaccactacatctacagtcgatgataacctgaagaaactgttgttagtggaggacaatcaggaattccgtactttcctgaaagaacagctggaagatttctatcagattattgaagcggcagacggcgaggaaggagagcggaaagcgatagaggaaaacccgaacttgattatcagtgacatcatgatgccaaaagtagacggtatcgagctttgccgtcggatcaagacgaacgtgcagacatcccatatacctgtgatattattgacagcccgtactgccgatgacatcaagattaacagctatgaagtaggagcagactcttatatgtcgaaacctttcaactttgatatgctgatggtacgcattgaaaagctgatagagcagcaggaaaagagaaaacaagaattccgtaagaacatagaagtaaatccgagtgctatcaccattacttcagtagacgagcagctcatacagaagtgtctggaatacatagaaaagaacatggataatccggaatatggcgtagaagaattgagtggcgatctggggatggtgcgtatgagcctttaccgtaagttacaatccatcaccggacacacaccgacagactttattcgcagcatccgtttgaaacgggcggcacaattattacaaggaagtcagttgccgattgttgaaatagcgaaccgggtaggattcagttcacccagctatttctcgaagtgttttagagaaatgttcggtatgcttcccaagcaatatgccgaggaatcgggaagaaaagaatgacattgtgcctgtgtttgtagtttaattattacatttgcgctgaataagtgagataattgtaagttcttgttcacattggggcagaagaagttttattttataatatatgttgatatgaaagtattagttttaatttcattggtaggaggtttgatgttatcctcttgcggaggtagcagttcaaaaaataatgcaaatgttaaggaggtaaatcctgcagataccatctatttgggagacttacgtgaaaaatttgcaaatgatagtgttttctttaaaatagtggcaccggatttgatgttgatggattatcagtatctttgggccgtaacagaatcggaagcagtagagaaaggactgacaaaagaatactataaacgtgtgaagaaagaaatcaccgatacgaatgaagcgatcaaaagaggtgtgatgaaaggtgcgaacgtaaaacgtataccggatttccaggcatcacaggaaaataaataatgaatccttccggatgaaagctttcatccatgcaaatataagaacaggggagtcgtcaaatgtaacgacctccccttttttattggtgtgacggttagatttatcccgatgaaatgggaagtttttgcaaaaatacacgcttgttacgatagttttgttatctgttacttttgtgatatttgaatttgaaacttgttcctacttttgtatcatcgttaaacggataaatttaatgccatgaataaacagcagactacatttgacgacttcttctccgaatgctaccttaaatatagggagtatatcaaaaattatatcgctatccgcatttgccatccgcacgaagcggaagatctggcacaggatgtctttgtccgcttatgggaacacagggcattcgtgaataaagacactgtctggtctttgctcttcaccatcgcccgcaatatcgtaacggacaagatacgtcgttattataagcaggaagatttcgtcgcctacgtatataataggatggaagacaccagtcggaataccacagaagataccattcattttcgtgaactaaagaagatgcacgaccaggtaatggaaactcttcctgtcaaacgccgtcagatttatgaacttagtttcaatcatgaactctcttgtcctgccattgcaggaaagctgtccttatctccccgtacagtagaatgtcaattattactggctcgtaaaacggttcgtacttatttgaaaaatgaattctccaaagtcggttagataccagattcggaaaaacacatattaactttaacaatttaatagtattatggaaattaaatccaaattcttatgttcaaaaggagtcgcattggctttcgccatgctgctgggtggttcgcccggtgtattgctctatgcaaatgattctgtagaagagagtttgatggtagcccaggcagggcgtaccatcaaaggacttgttacggacgcgaatggtgaaccgctgattggttgtaatgtggtggtcgtaggaagcaatgcaggggtaattaccgatattgacggtcggttcgcgctgaatgttcctgcggatgcaaaacaaattagaattacttatatcgggtatgcagatcagattgtcaatttgaatgggcggtcagatttcaaggttgtgttgaaagaagataataatgcattggacgaagtggtggtagtaggttatggtacgcagaaaaaagcgacgttgacaggggcggtagaacaaattggtagccaggtattggaaagtcgtgccattaccaatgtcggtgctgctttgcaaggagctactccgggattggtggtcactcgttcttcttcacgtccgggtaatgaaggattaaattttcagattcgtggtttgacatctgtcaatggcggtagtccgttgattattgtggatggagtacccgtattgaattcagagtcatttcaaaatctaaattcggatgatattgagaatattagtgtattgaaagacggttcagcttccatttacggtgcaaaagcagctaatggtgttatattggtaactaccaaaaaaggtaaaggcaagacaacggtagattatggcttcaatatgcgtttcactaccaatggtattatggctttttctcccagtatgcaggaatatgccaccatgtggttggaagccaataaagaaatgccggaacatgactggtggggctggggagaagaaaacctgaaaaagatggctcaaggcattgaaggaatttacgagtcgactgtagccgattggggtacaatgtttgtgggcaatgccaatcgcttggatgaattgtttgcccgtcgttattcttatcagcataatttgagtgtagcaggttctacggataaatctgattaccgtatttctttggcttatgctgataatcaagccaatttggccactgcctatgacgggcagaaacagttgaacttgcgtttgaattatggaatcaaattgactgattggttcaaattggaaacttcggcaagtatgattaaaacaaatactgaaacaccgacacatggtatcgaccgtacactttacggaaatgatgctccgttttttccggctaagaatccctatggacaatggtatgccaactttggtaatgtgggcgaccgcaatgcggcggcagctacaacagatggaggacgtgacgagagggaaaaactgactacccgtgtcgatttcaaagcattggtggatatttggaaaggaatcactttcgagggtactgcttcctttcaaaatgaggaataccgtagagaacgctattcgcttccggtacagtgttacaattggttcggcgagcagacggcgaagttagtatatgaaacaacacaaacccttagtactccgcaagatgtgatgaactttaaagattctcatcagccgggatatttggtacaggcaaataatgcccggtatcagtactattcagggttattgaaatataagcgtacatttgccgaagtacataatatagatgctatgttcggtatcagtgccgagaagtgggtaaataaaaaagtcgttaccgcccgtgagaagtttgaggatgccggaatttacgatttgaatttggctacgggtacacagggtaacggtggaggaaagactcataatggtacctattcatatattgcccgtttgaattataactatgcggaaaaatatatggttgaattgatggggcgtcgtgacggaaattccaagtttgctcccggttatcgttttaagagcttcggttccgtttctttgggctgggcgttctcggaagaacaatttgtagaatttttaaaacctgttctttcttttggtaagttgcgtttaagttacggtagttcgggtaatgatgtcgggctgggtgattacgattatgtgtctactgtctctcttggaacagccggttttggaactatacctgctaatcaagtatcttcaggttttggcggtttaatttcttatgaccgtacttgggagaaagtttcacagaaaaactttggtatcgatcttaactttttcgataatcgtttgaaagctacattcgattattttataaaagataataccggtatgttggtaaatgtcacatatccgggtgttttaggaggtaaagctcctaaaacgaatagtggtcatttgaatgtaaaaggttgggagttcactattggatggcgcgatcagattaaagacttttcttactatgccaactttaatattggtgatacaaagagtctgttgaaagagatggaaggagcagattcttatggggctggttggaatgcagccgtgaatgggtatcctttgaattcgtacttcctttatcgtacagatggttactttaaagatcaggcagaagtagaccgctattatgcactctatggagagggtaaagaagatctgactggtgtaggagcaggaagtgcaagccggttgcgtccgggtgataccaaacgtttggatttgaatggtgattataagatttccggtgcagggaatgagaatagcgatttgcaatatctcggtgactccaatccacattttgttttcggtttcacattgggaggatcatggaaaggttttgatgtgaacgcgatgttccaaggtgtcggtaagcagtatgttatccgtaatgactggatggcttatccttttcaaacacgtactgccaatcagaatccgacatatttgggcaaaacatggacagagagcaatccgaatgcggaattccctcgtctgactactaatgcgaatcttgcacgctggaattatcagaataacgactttatgatgcagaataaccgctatatccgtttgaaaacattaatagtcggctacacattgccgcagatttggacgcgcaaggtgaaactggaaaaagtgcgtgtttacttctctggtaatgatttatgggaagctaccagtattcgagacggtttcgacccggaaatgggagcagcctccaacaacagtggatacccgtttgcacgtacttggtcgttcggtctgaacatcactttatagtagctatggaaaattaaatacagaacagaagatatgaaaaagataacgaactatatattaatttgtacctgcgcattgggattttcttcatgcgtgaatacgttccttgatttggaacccctagatgccaagacagatgtgatttatttcaagacaccggaacatttccgtgaatatgctaacgggctttacgggcaattattgggatggcagtcttcttatggaagtatattcgatcacatggatgcggcatccgatctttctacttgtttcagatattcgtatggtgtgggaaccggtgtgatgggagttcctaatgacgatagtcgttggggtaattgctatggcaatattcgtgccactaatcacatgtttgaaagagctgtttcttcctatacaggtaatttggcagatattaaaaaagaattagccgaaggtcatttttttcgtgcctacaactacttttacttattgaagttttttggcggagtgcctgtcgttacgaaggttctcgacgtgacttcaccggagttatatggaaaacgtaacagtcgttatgaagttgtcgatttgattttgtccgacttggatgaagctatcgcaggattgccgttggaacagaatatcacttctgccgacaaaggcaaaattagcaaacaggctgcacaggcttttaaggctcgtgtgttactttatgaagctacctggcgtaagtacaatggcacttctactgattttgaaggttctgccggtccggcttccgatcaggtaaatactttcctggaagaatctgttcaactatccgaaacagtgatgggagatgctgcttattccctttggaattataacaatgtagcagctatgagaaatatgagcaatcgttacctgtttaatattgaagaagaagctagtaatcctgccggtgccggaagagcgacgaacaaggaatttatcatcgcttctgtatatagtcaggaaacgcgtaaaggacaggtagatttgaatcgggtgatttatacggatatgcgtcccagccggaaattgattgatatgtttttatgcactgacgggcttccggtcagcatgtctgataagttccagggatataagaatccgggagatgaatttcagaatcgggatttccgtttgacttcttatgtaggttcatatgctacgagcctgacagttgagaactgtgggtatggtgtttccaagtttgctattaccgatattcaacgccaaagtaaagatgaatcggccaattatccggtacttcggttagcagaagtatacttgaactatgccgaagctgtgatggagcgttatggtgaaatatcggatgaccagttgaataaatctatcaataagatccgtgctcgtgctggaattgccaacttgacaaatgcattggcaaagcgaattcaggaaggggtaccggcaaatgcgaataagacagtcaatcaggtgatgctggatgagatccgtcgtgaacgtgcattggaactctatatggaaggtttccgttgtgacgacctgaaacgttggggtattgcggaagagaatctgaatgagtctcgttgcggtgcggtggtaggtaatgctagttatcctacagcatttgtagacgaaaacgggaatgctaccagtgctttcaatccggctatttttacgaaaggaacggaagttgtagaaacaggtaaaggtaagttaccttgtgtagtgcttctcaaatcatctgactgtgcatttactaaaggagattatttgtgggcgattccaagaaatcaaatcaatctgaattcgaatctggtacaaaatccgggatattaatcattcaattgtttaacgtataataccatagattatatgaagtttttattcaaatatacatttcacttggcaatacttgcttatgtttccgcacttttctccggttgtgagcaagaccccaagtacagagtttatgattatcctgtgccggtagtggagagtatatatcccacagacggatatgtcactacgcaggttgttattacaggaaccaatttcggtgatcgtgctgaagcagtgaaagttttcttcggtgaagcccaatccaataaagtgctcgactgcaagaacaaccgtttggtagtggaggtgccggaaacggcagtaacaggcaatctgtctttacagatttataataaaaaggtggagaatatcggtcattatacagtactacctacaccacgtgtcattacagtgacttctgatagtgaagacggtgaaggggtagccgatacgggagacaaggttactataacaggtgaaaactttggtacggatccatccgatatttctgttagtttcaatggaacgccggccgaatttgagctggtggatgagtctactattgttgcgacaactcctgctgattatcagacaggtagtgtgactgtgactattcacggatatacaatgacaggtggtgcaatgttcaatcctaattcgaagggtgatgtgacagtgctttatcttcaaaactataagcagccgtttgccaaggcaaatgatgaaagttggaagaacggtgaatggtggactccggcagtgtggaatcaaaatgcagcatcgttcaatgcaaaaggcaatacgactgtttccggaatgcaatatgaatcagaagaaggcttaacgttagcattccagaatggatgggataaagaagcttatacgaatgggaaaatgtggcaggttgctacgctccgtcctggtaaatacagactggaagtcacttatgcatatacattggtagttactgatgcggggaactttatttccgtattgatagctaaaggagatagtgaaagtgatataccgaatgtcgctgatcttgagcaattaaatggagtttatgtggcctatgataaaatgggaacagcgaatgattcgggtacgttggttacaccttcatttgaagtaacggagacaacggacgttgttattggattcctgacttcattggcaaagggtaattcatactttaaggtgacagaattgaaattgattcttgaataatgtggaaaagaaaaaagagtaatccatcatgataatataattaagattatgaagaaaatatataactatctgtttcccgtttttctctcgtttttcgcattagctgcttgtgacgaggacaatgaagaaattgttccaatgagttacactgatcctgtggcgaccgtaacaaagatagaacccgtcgaaggatatgttggaaatgaatttaccattaatggtgatgattttggaatcagaaccgaagatgtaaaagtatttatcggttcccaggaggcaacagtcatctcctgtgccgatgatgctattctagcgaaagtgccgcaattggctacaaacggaaaaataactgttgaagtcttcggacaacgtgtagaaactgatcttgtttatcgtgtacttggtaaaccgggtgttagcgcagtgaaaccttcttatggttttcccggtaccagtattgttttcgaaggacaagagtttgtgtcttccaaaacattatatactttgactttcggaacttctacggataaggcagagattgtgggaacgcctactgataccgaatttacagcaaaagttcccgagacggctgtcagtggagtcatgacacttgttatggcagaacaaacgattgatttgacttcttatcctttcacggtgttgaagcatgcaacgcttgatattcctaaggaagacgaaccggttacatcaggttttgctggcagtaaatttgcaataacaggaaccaatcttgtgcaagaattgctggataagtctgttgaagggttggagcctttgaaagtaactttttctaaagctggcggagaacctgtagaagctgtaatagatacagataatttgacggataagagtattccactcactgtacctgcttcgttggaagctggagattatacaattactgtcattactccgtttgaaactatcgggacacagttgaaatatacggtattaccgatgcctacagtaacaggcatttcaacgaaagccggatatattaatacggaagtaacgatcattggtcagaactttggtacgaaagctgaaaatattcaggtctttttcggagaaacagtttgtgataaagtgacactgaatgataaaggtaatatcgtagtgaatgttcccaaaggagtttcatcggaagctccggtgaagattaagctgataattcagggtaaggaaatagagatgggcgaatcgggcacatttgaggtttgggaaactccggaaatcacttctgttgaaacaccgtatatttatccttatggtacattagtaaaagccgggcaggaaataacatttacaggaaaaggttttggaacggataagaattctgttacagttacttttgagggaatatccgtacccgttacggttaaagagattactacgacttctattactgtaacggttccgcaaggtttcaatggtggaaaagtaacaatggtgtttgaaggtattgcacaacccgtagagagtgatatgttacaacctctgccggtggatggagatatttctcaatatgtactcatgaactataaacagccttttgaatatgtaaaagaaggtggggataaaggattccataaaaaaggagagtgggcaaaagctgcttattggatagttcagaactctaacttgactgctggtgaaggaggtgctgctgttgatttggcatttaaaacgaaatatggtgatggaagtgatgcaggtttggctttacaaacagattggggatttgacaatcctaaaaatgatggtaaggtatatcagacttctcatcttcaaaaaggaaaatataagttgacggcacacgtttatgaatatgacggcagaggttttaccggttatgttgcggtttgtaaaggtaacgagatggcaaatacgagtgatataccaagtaagagtctggcaaacgcttctatttcgggtacgggtgatgtagtagttgatattcttgttgaagagcctaccgatgttgtcattggttttgtatgtacgattacagtaaaacaaggacgggctaagatagataatttcaaattagagttagtagagcaataaactataattgggtgcaccgtaatcaatggtacggtgtaccattaaaccaaaaatatgatgaaaaagatatattatatagccgtggtattcgctatcctgtttttggcaggatgtggtgacggcattgaccttccgggtgtcaatgtggaaactgatttgaataaaattcctcttcctgataataacgtaaatttggaacaggttgaacttaaaccgtcaacggaacccatgctgcatgaagggttgcatacggaggaagacttccagcgtatccgggataaaaaagctgccggagaagagccttgggttagcgcttatcaattattagtagaaagtcagttttcgcagaagacggcagatacttatcctacggaatggattaaacgtggagtttccggtgatgaaaattatatgaatgcagccagaggggccactattgcatatcagcaggcgcttcgttggaagattgaacaggatgatgaatatgcggcaaaagcagtggagaatctgaataagtgggtacagacttgtgtaggtgtaacaggtaatacgaatttatcgcttgccgcaggactttatggttatgaatttgctattgccggtgaattattgagggattatgaaggatgggatcgtgcggacttcgcagcgttccagaattggttgcttaaagtgttctatcctgctaatgatgatttcttgaaacgtcatcacgatacgaatgcgttacattattgggctaactggtgtctttgtaatatagcggctaaaatggctatcggcattgtaaccgatcgtcgtgatatttataatgaaggtatcgaccatttgcagacgggtgatacaaacggacgtttacgtcgtgctatctatcacgattatgcaccggactataactttgctcaatggcaggaaagtggacgtgaccaagggcacacgttgatgtgtgtcggattgatgggagttatttgtcagttggcatggagtcagggagacgatttctttgcttatgatgacaatctgttcatgcgggcttgtgaatatgctgcttgttgtaattacactaatgagactgtaccatatactacttatatatggcaaaaacagagtcaatggggatatccgattctggaagagcaaacaacacttggtggcggcaaatggatcaaacgtgcaatatgggcattgccttattatcattacaaagggataaaaaatatctcgaatgataatctcaaatatactaagatagctacggaatatgtaggaatagaaggaggaggtgggtattatgacgctaactccggtggctatgacgtacttgggctcggtacgctgatgtatgcaagataaaatgaataaaatgtgttagacttcgccacagattcggatatgccagtgtggatggattatttgtttcaatctgtggtgaattccaggacattaacggtattagtaaaaacttgaaatgaataaactaataagaatagcgctcacatttttacttgtaatgaccacaggagtcatacaagcagaaatagtcatctatccggtacctcaaggcatctattatgcccgtcacaatgatgactatacggtaaaagtacggcaagtgggagaaaaagactgggtagacctttatgagtataacgtaaaggtggatatggatacgaagtccgatgccacgatggttcagttcgacttttcagggaaagtggaagtattggtacaaaagaacaatggggagatccgttcggcagtggtgcgtcctttatccaaaggtatccaaccggagattgatggtaactttctattgtttacgatagataaaccacaaaagttgtcggtcgagtttaatggagatcgcctgaataatttgcatgtatttgccaatcctatcatcaaaaatgtgccggataagaatgatccgaacgtgatttattttgaagctggaatacatgaaccgactgatacggctggaaaatgcttccgtattcccagtaatacgacggtttatttagaaggtggtgccgttttgaaaggttgtctcacttgcgacagtgtagagaatgtgaaaatattgggacatggcatgttgcttgaaccgcaacagggaatttcggttacctactcccggaatgtactgattgatggagttacggtggtaaatccacggcattatactgtctctgggggacaatctaccggaattactattaaaaatctgaaatcattcagctatcagggttggagtgatgggctggattttatgtcctgctcggatgtgatgattgatgatgtgtttcttcgtaattcggatgattgtatagctctttatacgcatcgttggaattattatggagactgtcgcaatgttcatgtacttaattctactctatgggcagatattgcgcatcctatcaatatcggtacacatggaaatacggaaacgggagatgaagttttggaagatatagtattcaggaatattgatatattggagcatgatgaggatgatcgtgattaccaaggctgtatgactatcaatgtaggggatcacaacctggcacaaaacattacttttgaggacattcgtgtggaacatattcaggaaggacagttatttcatcttcgggtgatgtataatcaaaaatacaatacaggtcccggcagaggtgtcaagaacataacattccgtaatatttcatgtaccgggaaatatatcaattcttctttaatagaaggttatgataaaaataggaagattgagaatattttgttcgaaaacattgtgttgaacggtaggcggatcacttctttggaagaattgaatatagataaaaaagattttgtagagaaaatacggataaagtagctaataactaaaagatgaaagatgcgacaaaaaacagtttttcgtgctttttgccgcatctattttatagaaagaggaataaacctatcgtaaaggagtgaatgaacctatataaatgcgttctattttcagggaggtggcatttattccgaataggtcggtcacatctgatttataatcttcagtcacatcttccactaaccaataaggaatcgggccaaggtctcgtgtggtgatactctttgaagtatcgggacgttcgggaagtttaaatttgcagtcatactctttaccattgattgtaatttggaatgtagtgcctgactctgatgtggagcgggagaagcttccttctattttcggagcattatctttactagtaacaattgtcactttaccactacttttttggtcataagagaaagctattcctcctgtagcttgtatacccgcttcatcctttatcatttttatgaccgcttctagtttttctttttgttgttcatccaacagactttcatctattcctgtgattcttgcttccacggaatttactgaaaaagattgtttgccgttgacgacctttagtcctatttttatgattcttccatcagcgtctttcaccatcaatgacgtgctgcccagttttatagagctgatccgaatatcattgttttcgtccacataagctgtagcaatttgcccatcggctatttctgctgtataaggagctacgccacctttaattcccaactttgttcctcccgtgattgacaaactggtttcactaattggaggttccgggtcgaacatcacttcccaatattcatataggtaaaaagcatcagcttcgtcgctgcatgaataaaatacaggaagggagcataatagaataaatagtagacagagcttcgccatttttgctttcataatattcttcttttttatttcttcacaaaagtaaagctcctttcctgtatttcaaagtatattgatgaaaaataagattaaaactctatcttatgttgtttctcatcatccaccacagccatcattccttctacctgtgctaaagccagcatacgtccgtggaaagaataaccggcattgtagcctttatcctcatctccgagcatcattcgtccatgatctacgcgcatgggaagtcccggattctctttctcgaaaatgcggatgagatcaatcagatgtcctcttcctgatagatgagaactttcgatgaagtttccacccggcatggcctctgtactgcgtagatgaacgaaatgggttcttcctgcaaacttctttgccaattcacgagtatcattatgtgcgcctgcgctaagagaacctgcacagaaagtcagcccattatgcggattgtctacggcattcaggaaccaggctatatcttcttcattggtgacaatacggggtaggccgagaacctggaatggaggatcatccgggtgtacgcacatgttgataccatattcatcgcatacaggcataattgcagaaaggaagtaacacatattctctcgtaaagcgtcccggtctatgtctttatataaacctaacagacgtttgaatatagcaaccgggtttttatctccttctttgatattaccgttcacaaatccttgtgtcttgacgataatagtatcaatcaaatcatccttttcggtctctgtaatcactttgtccagttcggcaactttatgcagttcttcttctgtatagtctttttcagctccttcacgttctagtattttgatgtcgaagtaagcgaaacgaatacggtcgtagtaaagcgaactggtaccgtccggccaagggtactgtaaatccgtacgtatccagtcgattaccggcatgaagttgtaacagactgttttcactccgcatttacccaggttggcaagacttactttataattttcaatcaactgttcacgttccgtacccgcatacttgattgcctcacaaaccggaaggctttccacgaccgaccagcgcaacccatacgattcaatatacgattttaaatcgttgatggcttctactgtccaaatctctccgttcggtacctcgtgtaatgcagtgacgattccttcaacacctatctgacggagcatcggcaaggtgattttatctttcttgccgaaccatctccatgttttttccatcatagcgtttgaataaattaaaagattaaatattaaacgccgctgaatgcactgaaaccaccatcgataggcaacatagctcccgttacgaaactagcggcttcactacacaggaattgtacagcaccattcaattctttgatgtcgccgaaacgattcatcggagttttggctaacacctttttacttctgtcggtcaatgaaccatccgggttgataagtacacgacggttttggtcaccgataaagaatcccggagcgatagcattaacacggataccatcaccgtatttcagtgccatttcgcttgccagccattgggtgaagttggctactgcagttttagcggccgagtaacccggtacacgggtgatagcactataagcagccatagaagatacattgatgatgcatcctttcttctgttttgccattaccttaccgaatatcatagacggatagactgtcccattcatattcaggttagtcactttttcccagcaagagatgtccatatcatagaagtgctgatccggttcgagagtggctcccggcatattgccaccggcaatgttcaatagaatatcgatctttccccatttggctacaacttcttcggctactttctccaggctggcgatgtcaagtacattaccaatgatgccgattacatcgttaccatattgcttaagttcagctacgcggttgtccagttgctcctgacgaatgtcaatagctacaacttttgctccctgctgtacaaagtgttgggcaatatttccgcccagtacaccacctgctccggtaataacagcaactttaccggcaatactaaataattcgttcatgttttctatcaaatgtttttatgaatggatgcaaaaatagcgggtttttatacatgctatgatgcgtatttttgcaagatatttacctatctttgcaaaagcagtttagaaaggagatttatgaagaagataatgaatgagaagttgactattacgacttctaatcccgtccgtgcccgcttttatgaatatccacgtttcacgtatccgtggcattttcatagtgagtatgaaattatttatgtggagaagggagagggggattgtctggtgggtgacagcattatctcctattcaaaaggtgatttgattcttttcggttccgaactgcctcatagtatgcaaagtccaccggacggcggggaagaatctgataacgaagaaaaatccgaactgaaagtaagaggagtcaatattcagtttgaaaaagacttcatgcattattctatatctcaatactcccagtttattcctatcaggaatttattggaggatgcttgcagaggaattaaattcacaattacccgttcggggaaaatcattaagctattaaaacaaataccttctgccaaaggagtagatcaaattatcctgttgctttcactcctacaaatgatggctaccagtaatcacaggaagtatctgactacttctcattatactccgtctccttcgattatgcgtaatgaaagaatggaaaaagtgattgcctatttgaataaacattataccgagtctatcggtctggatgaaattgcttcttatacagcgatgaaccctactgctttctgccgatactttaaagaaaacacaggaaaaacattcaaagagtatgtacttgatatgcgtatcggatatgcttgtaaactattgaatagtagtatgatgaatatatctcaaatcagtgctacttgcggatttgaatcacctgtacattttaaccgcatttttaaaagggtgacaggaatgacacctactttttatagggaacagatggaataagcttttcaggcaataaacatttgagtataatttctttctcgttcgtatataataggaaagatgaataaacatgaacgtaaatagaatgaagaaaagaattttgcttttgttgttggtgataccggcattgataaaagcgcaagatgtgatgacagaaacccgtcaggaactgacgtctcctgatggagcttatcgttttaccttttatcaacgtgcggtaggagaggataatgcacaaatgtattataccttgacttataagaatcgtccggtaattgaagaaagtaaactgggtgttctgattgaaaatcagttatttgaatcggcgttgggtataccgaatgatacttgtcatttttggtgtgagaatctgaagttgacagagactgaacatcaaaagacggacgagagatggaagcctgtatatggcgaacgtgcggaagtacgtgattgctacaatgagatgactttgaaactcaagaagggagaaggaaatggcaatcaggacggtggttatgataagcgtaagaattactttatgaatatcatagttcgcgcctataatgaaggagttgctttccgctatcattttccggaaatgacaaacgggcttttcttgcatatcgtcggtgagcagactagcttcacaatgcctgaaggaacgatggcgtattatgaacgttgggcgcaaggatcttatgaacttcgtccgttggaaggatggggcaaagaggagagtgagcgtcctttgaccttgaaactgcctgatggattatctgtagctttgttggaagcggaaatggtggattatgttcgtggtaaattccgtttatcggcagagaaaccttccactttggagacaagcctgtatagtagcgttgatattatttctccttacagcactccgtggcgtgtaatcatggctgccgaacgtccggtcgatttaattaataacaatgatattgtcttgaatctgaatccggcttgtaagctggctgatacttcttggattaaacccgggaaggtattccgttcgggcgacttgaaacaagatagagtaaaagcagccattgactttgcggcagaacgtggtattcagtatgtgcacatggatgcaggatggtacggaccagagatgaaaatgagttcggacgctactactgtttctcctgataaagaccttgatatacccgctttgtgtaaatatgccgaatcgaaaggaatcggacttatggtgtatgtcaatcagcgtgcattagtgcagcagttggatactctgttgcctttgtataaaaaatggggattgaagggtatcaagttcggttttgtacagataggtaatcagcgttggagtacttggctgcatgatgcagttcgtaaatgtggagaatatggtctgatggtagatattcatgacgaatatcgtccgacaggtttcagccgtacttatcctaacctgatgacgcaggaaggtattcgtggaaatgaagaaatgccggatgccacacacaatacgactcttccttttacccgctatctggcaggtgcaggagactatacgctttgctatttcaataatcgggtgaagaatacgaaagcacatcagttggcgatggcagctgtgtattacagtcctttgcaatttatgttttggtatgacagaccggaattctaccagggagaagaagaactggaattttggaaagcaattccgagtgtatgggatgacagccgcgcgttagatggagaaattggtgaatatatcgttcaagcacgtcgttcggggaatgactggtttgtaggagcaatgacgaatacggaagcccgcacaattacattgactacggattttctggaaccgggtaagaagtatatgcttcatctgtacgaagatgatgacaagctgaatacacgaacgaaagtacgcagtactcataaaaagataaaagccggagataagcttgttttgaagctaaaagcaagtggcggaaccgcattgcattttattccgcttaagtaggcaagtttatgtttctttttaggcacggataacgcagattacactgttgctttatgcaaccatcatttctaaaaccgtgaaatccgtgtaatccgtgcctgaaaaatatagtgaggtattatttgctataattaatcaaccacttcaccatttccgggtcgtaatgagagaagaggagagttttctcattcattgagtggaaaggttattcaaggaattaaagaactaattccttgaacaacctttctaaagtattatctaaatctgtagagaatcccggatgaggacgggatacttgaatacaggagctttttaccgcagtcagccaccggaagcggtccggaatgtccatattggcaataactcctccttctttatttccctgacaaatcttgtcgaagactttcagaccttctatcagacagttgatgtccaattcggaagagaacagtttcaatttgttttcatctattgtataaagagatttgagatatttgcaccgtttggaaaacagtacaatacctacattaataaattcctcacgttctactttaggaacgaaacggataactgcgtattcatataagtgcctttcttgcattttgcgcttcatttacaaatatttcggaatgcttgatcctttcttctaaaaattgaatataaacatctctcaagtcttgcggagtttcctgtccttccgtccagttcagccagtcgtcagggacggcattgactatctctcgtatcttgtcatcggtaagtagttgtttgaatgttgcgtctacttcttccagctgatcggcaaacggcaatagtacatgatcttttatttgtacgaacggactaagtgcgtgtttctgccaattcgtccacgaatgatggaaataaagggaagctccatgatcgattaaccacaattctttatgccacatcagcatattcgtattcttgattgtacggtctacattggtcaataacgcatccagccatacaatttgcgaagcagttttaccgtccaccttatgcacaacagggtcgaacgtcaatgaaccggacaggaaatgcagacccatgttcaacccacggctccattgcagtaaatcctgtatttcttcatccgcttctgtccgcccgaaagcctcatccagattcaaaaatataatctccggaactctgaatcccagtgtacgggctatttctccccctatcaattcggcaataagggctttagtcccatgtcctgctcctctgaattttacgacatatttaaattcatcatccgcttcagccaaagccggcaatgaccctccttcccgcaagggaagaatatatcttgttacgtttgctgtacgtaaatccatatcactcctttcttaaattgagaataaagatacaacgtttttatggaatagtcagtgaaaggcttcctataataatagtttttttatatttttcggttgagtatactttcttcctgctacgtattatataaaacaatgataaatgaattaaacatgaaactacttcgatttttggtgtttggaataatgtccgttattctgttacccagcattatagcagccgaatggcagtggtctgtacaactaccaagtattatttccaacgaaacgaacgatcatccgcaagcattcttgtggataccttccgattgtactcaattgaaagctgtgataataggcaatcataatatgacagaggaaactttgtttgaaaattctctatttcgtgaaagattatcagaagcgggtatagcactgatatggattactcccggatgggatcaaagatgggatataactaccggatgtcaggaagcttttgaaaagatgatggaggattttgcgaatgtcagtggctatagtgaattgaaatatgcgcctattgttccgttcggacattcggcaatggctacctatccgtggaacttcgcagcctggaatcccgaccgcacactagccattatctctttgcatggagatgcgccacgcaccaaccttaccggatatggtcgtgacaatatggagtgggggaaacgtacgattgacggcatccctggattgatgattgaaggcgaatacgaatggtgggaagaccgtgtaaatccggctttggcattccgtatgatgtatcctaaaagttgcgtctctttcctttgcgacacaggacgaggacatttcgatatagccgaccgcaccgctggttatattgcgttgttcttaaagaaagcactggaatatcgtatgcctgcaacgtatgatttgaataagcctgtggaattgaagaagctgaatccgcagaatggctggcttgccgaaaggtggtatccgaatcagaagaaacgtgcaaaagctgctccttataaagagtataaaggagactcgcacgacgcattctggtatttcgataaggaaatggctgaaatgacggaagaacgctatcgccgggagagagggaagaaaccacaatacttaggttttgtacaaaaggggcaattactcacatataatcccaaatcccatgtgaaagttgccgccagcttcctgccggaaaaagacggattgacttttcatctgaaagctgtatatacggatagtttgcatactgcaatttctgacgaacattcgctcactcctcctgaaataacccgtatctgtggcccggttcagaaagtgaacgacaccacctttactgtccgtttctaccgtatgggaatgtacaataagcgtcgtacgggagatatttgccttctagctggtaatgatggtgacaaacattataaaagcacagttcaggaacttagttttcggattccctatcgcaatacggaaggtaaacgccagcatattcttttcccgggtcttgacgatgtgaggaaaggcacggaaactatctctttacatgcaacctccgattgcgggctacccgtatattactacgtgaaagaagggccggcagaaatagagggaaacaagttggtatttactcgaattcccccacgcagtaagttcccattgaaagtgactgtggtggcatggcaatatggattggcaggagaagtgcagacagccgaatcggtagaacggagtttcttcatttatcaataggcaattgataaatgaaagattatggcactataagttggaattcgtttttttgcattgagtaataggcggagtctattcgtatccaataataaataaggatattaaaaatgattatgaataagaaatctttagttgcaatcgcattattggcagtatcggctatatcgtcggctcaatctgtgtaccctggacagcaccaggggaaaatgaaaaaagagacagtggctcctgttcgggtagaaagttttgatttgaaagacgtccgtttattaccgagtcgttttcgtgacaatatgttgcgggattccgcatggatgacctctatcgacgtaagtcgtctgttgcatagtttccggacaaatgccggagtctttgccggtcgtgaaggcggttatatgacagtgaaaaaactcggtggttgggaatccttggactgtgagcttcgcggacatactaccggacatctgctttcggcttacgctttgatgtatgctgctaccggaagtgagattttcaagttgaaaggggatagccttgtcaacgggctgaccgaagttcagaatgctttgaaaggcggatatttaagtgcttttcccgaagaactgataaaccgtaatatccggggaaagagtgtttgggcaccttggtacactttgcataagctttattccggcctgatagaccaatatctgtatgcggataatcagcaggccttgaaaacagtgaccaaaatgggcgactgggcttataacaaactgaaaccacttagtgaagaaacccgcaaactcatgatacgtaatgagtttggaggtgtcaatgaatcattctacaatttgtatgctatcacaggagatgaacgttaccgttggttggctgaatatttctaccataatgatgtaattgacccgttgaaagaacttcgggacgatttgggaaccaaacatacgaatacgtttatcccgaaagtcatagccgaagcgcgtaactatgagttgacagagaatgagaccagcaaaaagctctcggaattcttctggcataccatgattgaccaccatacttttgctccgggatgcagtagtgataaggagcattttttcgacccgaagaaattttctaaacacttgaccggctatacgggagaaacctgctgtacttataatatgttgaaacttagtcgtcatcttttctgttggacgggcgattcatctattgccgattattatgaaagggcactatataatcatatcctgggacagcaagatccggaaacaggaatggtcacttatttcttgcccttactttcgggctcacataaactgtatagtaccaaagagaactctttctggtgttgtgtcggcagtggattcgaaaatcatgctaagtatggagaagctatctactaccgcaacaaccagggaatctacgtaaatctgtttattccttcccaagtcacctggaaagaaaaagggttaacccttctccaggaaacggaatttccgaaagaggaaacgacccggtttactattcgtgccgagaaaccggttcgtactactgtttatctaagatatccttcatggagtaaaaaagcggaagttcttgtgaacggtaaaaaagtagcagtaaaacaaaagccaggttcttatatcgctatcacccgtgactggaaagataatgaccgtatctcggctacttacccgatgcagattgcattggaagccactcccgataatccgaataaggtagctttattgtatggcccgttagtgcttgccggagaacggggtacggaaggtatgcaggctcccgcacctttctctaatccagctctttataatgattattatacttataatttccatgtacctgccgatttgcgtacctcattgaaagtagatatgaaacatccggaacgtactttgcagcgtacaggaaaagaactggaatttacaacagaacaaggagatgtgattcgtccgctttatgatttgcatcatcagcgttatgtggtatattgggatttgcagtcgaaatagaaaattttaagaacgaattacacgaattacgcggttttataattataattgcatcaaatataattgcatcaaacaacagcgtagttcgtgtaatttgtgtttaatacgaagttaatagataacgaaaatgaagggaagattattaatcataatttttataagtatctgttttattgcaggttcctgcaatgtatcatccgtacaagggagtcgttataacttctcttcattagattctgttattcaaggctgggtgagtaaagagtactatcccggtgcttctatttgtgtagtaaagaatgattctgtcatttttcagaagaactatggtagctatactcctgatacaaaagtatacgtagcctctgccggaaaatgggtggcggctgctgttatcggagcggtagtggacagtaccagtttggactgggatgaccctgtggaaaagtggttgccggaatttaagggagatgctaaaggaaaaatccttttgcgacaattgttatctcatacttccggagtgcgtccctatcttcctgaaccgcgcgtagataattacaatcatctggattccgccattattgagatattgccgttagatacggtttttactccgggaagccggttccaatatggaggacttgccatgcagattgccggaagaatggcggaagtggcaatggggaaagagtttgaaactctttttcaggaattattagcacagccattagaaatgaaaaattctcattttactccgataaatacagatggcggacatgccccgatgttaggtggtggtctgtgtactaccttgaacgattatattcatttcctatctatgatttatcatgatggaatgtataacgataagcggattatatcagcaaaaactgtaaaggaaatgcaggccgaccaagtgaaaaatgctgttgtttctcccgaagaatatacggaaagagcattgggacagtctcataatggcatttacggattaggtgagtggcgtgaactggtcgataaaaagacaggagaagcctatcaaatcagttcaccaggatgggctggcgcttacccgtggatcaataaacgggagaatgtttatggcttctttattgctcatgtagtcggtgcttccagtaaagaagatggtttctcatctttttatggtagtcctgtaatttcgagaactgtttcagagattgtaaagggacatccgttggttgttaaacaaggccgcgttaaagtgggcaacggttctctttactatgaggaagccggcacaggtgcccccgtcatctttgttcatgggcattccttggatcatcgtatgtgggatgaacaattttctgtactggcaaaaaaatatcgtgtgatccgctatgatttgagaggatatggcatttcgtcttcacaaacggaagactatcaattcacacacgctgaagatttagttactttgatggattctttgcacatcaagaaagcgcatatcgtcggactttctttaggtgggtttattactgctgatatgttggcgtatttccctgaccggatgttatctgcttttttagccagtggaaacattcggaaatcgaaaggtcccagtgaaccgatgactccggaagaagcaagagtacgtgataaggagattgctgctttgaaagagaaaggggtagatgtgatgaagaaagagtggtttgaaggattaatgaagtcaggaggaagtcagcgggaacgaatgcgtgagtctctatggcaaatgatcgatgagtgggatgcgtggcaacctttacacaaagaagtacgggtggtagctggtttggatgccattgaggaattgaaaaagaatcatcccgatgtacctgctttaattgttgaaggtcattcttccggcaaccgattctcaaaagaacctcccatcttacaatatcttcccaatggaaaactgaaagtaattgacgattgcggacacatgctgaatatggaacgcccggaagaatttaatgcagcattggaagaatttttgaaaaacgttcaataaagaataatattgtaactgattatatatagaatagactaagtaccatgaaacaaactattattgctgttatctgttttttgtgtgtttcttcattatatatacaagcacaaaaaataaatcatccttcattactgtatactccacaacgcatacagcaagtgaaacagcgtatgcagcatgaacctaaattgcaggaagcatggggagatattaagaaaacagcagataaagctttgcaaaagaaagattttaatcgattagactatttgtcgttagcttatttgatgactgataataaggagtatgcagacgcaatcaaagaaatcctcctgaaagctgtggaagccgaatcatggggagatgtggaaatgatggcacgtattcctgcatggcgttcacaactgggtatggctcataagagttttctttccgcagtggggtatgatgctgcatacaatgtcatgtcttcttcagaaagaaaaaagatagccgaaggattgaaacggttagccgtagaaccggcattgggagactggttgttggaaccgacccgtattcactcattgaattcgatgggacataattggtggacctcctgtgtttgtcagggtggaatattggctttgagtcttcaaaatgaacttcctgaagttaaagaatgggtggagcaacttcacgaatcacttcctgaatggtttgattttgccggtgatgtattgcaacagaaagcaaagagttttgatgaggccggtggaatgtatgaaagtctgaattacgccaactttggtattcaggaagctttgttgtttaggatagcttggataaatactcatcccggacagaatccgggtgatattcctcaattggcaaaattgccgagttacttctcacaagtctgctatccgcgtacaggtatgctgcatagtttgaattttggagatagccataaaaatgtatcagcagaatccagcatgatgttattgtatgcattgggggtgaaagatccaactattttgtggtatatagcccaggtggaacaaggacaacatcgtgatggctttttcctgaatcgtcccatgggcttcctttacactcctgatttgagtaaggcgcccgctgtccctcaactgccgacttctcaattatttgccgattttggttgggctacgatgcgtgattcgtgggaaaaggatgctacgatgctggctgtaaaaagcggtcatacatggaatcattctcacgcagatgccaattcatttattgtctttcataaaggggtagatattattaaagacgggggaaactgctggtatcctaatcctgcttatcggaattatttctttcaaagccaagcgcataatgtagtattgtttaatggagagggacaacctcgtgagcagcagtacggcggttctactttgagaggatatttgcatcatcttctggatgcgggaaatgtgaagtatgtcctggctaatggaacggggcctgtttcaaacaatttcagccgtaatttccgccatttcctttggatggataatgttatttatatgattgatgatttgaaaacacataaaataggacaatttgaatggttatggcatacaaacgggacatataaaaagtcgggagttgacgtgaatgtgacgaatggtaactcatcggttgtgattcgtccgttatatcctcgtttgctggctaaatccgattttgtgcatgactacccggaagatttgtattgggaggaaatagaagctcccactgaagatttgaaaggcactgaaacctattattcatttcatttgccggcagaagtcaatcgtgtaaaagggctgacagccattatattaaaggagactcccaatgagaaagacttgccacaaatggaacggcgggaaggacaagattggattgggcttcgtatccgtcataaagggaaagtgactgatctttatattaatcaattagcagacggcaggctaatgcacagcaactcatggattatgccggacggctggatgacagatgcttatatgtttgctgtctcttatcccgaaggtactgaagctgctgacgcaaaagatttctttatctgtcatggcagtgcattgagacgcgataaggagacttatttttcttctctttccaaattatttgtaattcagaaagaagaaggtaaaaagttgaacctttggatagacgggcaaccgaagattcatgcaacgttcagaagtgagaagaaaccgacaactgttattgtgaatggtaataacttccctgttgtttacaaaaacgctcatgtgaaagtgaaatatcaataaatcttcaatagcattgagtaaataatttctccccttcgtatttgtttatcacatataacagatacgaaggggagactttttttataagaaggaatgtgctcttttggagatttttatgtatgtttgtcacatgtttaatatgaaaggaagcggttgtaagtgaagaacacgattaaatatctgattcttttaatcatatacttggtttgtggtgtaaatctgcaagcccagaattatacatttcgtaatgtagtcatgtccgatggactgtccgggctattggtgaacgccatttataaagactcggaaggttttgtctggctaggaacagataattgtctcgatcgttttgatggtgtgaaagttcgacattatgaatttcgaggcgtggattccggaaggaagaaacgggtgaactgcatcacggaaacagccgataatcagctttgggtaggaaacggtatcggactttggcgtctgaatcgtgcaaacggccagttggagagaattgttcccgaaaaaatagattttgctgtaaataccttacttccggatggagatattctctatatcggtacggagaaaggattgttcattcaaaaggacgggcaattgctccaagtcttgaccgaccggaatatgctggctgcctgtaatcgaattatggatctctgtctgaatgaagataaaagtgcgttatggctggctacagtgcaaggtttgttctcttattcattgaaagatggtaagattgattcctggcatttccaggagaatgttcccgaggccgattatttccgctgcctgactcgtatcggagaaaccctttatttaggtacaatgagtcagggagtagttcgtttcgatataaacaaaaagagcttttcgcatacagtgtctttaggctgtgatgtcatttccgacatatccagtgatggaaaggagacagtatatattgcaacagatggcaatggcgttcatttcctttcgcataaagcccaacaagtgacacgtcgtttttgtcacgatgtaagtgataaagaaggtattcgcagtaattccatttattcactattggtggatgacagaggtgctgtttgggtggggcactttcaggcaggtttagattactcactttatcagaatggtcttttccaaacttatgcttatcctcctctgtttaactctgccaatctttccattcgttcttttgtcaacagaggacacgaaaaagtcatcggttcacgtgacggcttgtattatataaatgaagctaccggagtcgtaaagagttttgtgaaacctgttttgacttcggatttgatattgactatctgtttttatgaaggcgaatattatattggtacgtatggcggaggcatgatggtgttgaatccggagacgttatctctaaaatattttgcccagggaggagatggagatgcagagctgtttcagaaaggacatatcttctgtgtgcgaccggatgagaaaggaaatctctggataggcacttcacagggattgttctgttataataaacaggcaaaacagatcaaacactttaccagcgccaattcccaattgccggaaggtaacgtttatgaagttagttttgactctaccggcaaaggatggattgccacggaaaccggtatgtgtatatatgatcctgcttctcaaagtttacgatcgaatgtgttccctgaaggatttgtgcatagggataaggtgcgtaccatttatgaagatacaggacacaacctttattttattcgtgaaaagggaagtctgtttacctctactttaacgatggatcgttttcggaaccgttccgtcttttctacgcttcctgacaattcgctgatgtcgatcgtggaagataaccagggttggttgtgggtggcttgcaatgatggattgttacgcataaaggaagaaggagaagagtacgatgccttcactttcaatgatggagtaccgggacccacttttacgaatggggcagcttataaagatgaaaaaggaatattatggttcggcaacaccaaaggtttgatttatgtcgatccgaagcgcgtggatgaagtgcgtggtaaagtccgtccgattgtgtttacggatatattggctaatggtatttcttttaccaacccgtctttaaaatataatcagaataatctgactttctgctttacggattttgcttatggtctgccttctgctctattgtacgaatatcagttggaaggagtggataaagactggaaactattggctgcgcagaatgaggtttcctattatggattatcttccggaacttatacgttccgtgtgcgccttccgggaaatgaacagtcggaagctgtttatcaagtgacggtgcgtcctatgataccttggtggggatgggcactttctgttttattaattgtaggcattattgcttttatacgatattatgtgtggaatcgtatgcgccgcctgcttacttctcctgcatcggcaatctccgcgtccatagagaagacacagcagaaagaccgaacgatagaacaggcggaagtgatttctgaagagtcttctatcgctgcaaccgaagaaaagtataaaaccaacaggctgactgaagaagaatgtaaagaactccataagaaactggttgcttatgtggagaaagaaaagccatatattaatcctgatttgaaaatgggcgacctggcttctgctctggatacttcttcgcattcattatcgtatcttttgaatcaatatctcaatcagtcttattatgattttataaacgaataccgcgtcactcaattcaagaaaatggtggtggatagtcaatattcccgctatacattaactgcactggcagaactttgcggcttcagttctcgtgcttctttcttccgctcattcaaaaagagtacgggagtcactccgaatgaatatattcgtagtataggtggaacagccaaagaagagtaacttttcgacttattatcactgaaatctattttatactcatatccctttcacccttcacaccgccctattcatcggggttatagggtgaaggacctcccttcaccaagtggattttccttttactagtctttttctcgtaatctattaatagataagttcttcttctccctatataaacttcttttggtcctattgtaaagttgttttctatagggagtaatctataaacgcaagctttgtttttataaatgcaacttgcgtttataaaaacaaagcttgcaattatataattgaagctttcatttatagtttgcccttaatcaaacgtaactttgcaataagtgcaaagcaagtttatctttaatgaaacggaatttatctattaatgttcgtacttcattaatagctttgatgtgacaatgaaacgatcaaataataaaattgaagaggggaagaggatgggagcaaacgagcgtaagtggagcaaagatacgttgatttgagtgatttgagtctcattttataaagtgatactctctttttgtgaacgtaatatattgataattagaattatatgtttaaataagtctacctagattcattgagattgatctgctttattttctggctgttatatccaaaatcacctctatatttgcatcgtgatcaaaaccgaaaaagatagtattatggagacaacagctaacacttccgacaacattatcacccgttcttatgaagaatattatcaggtgattcttacctatattacttatcgtatcactcatcgctacgaagcggaggatctaacccaggatgtatttgtacgtctgctggactacaagcaaatgctccgtccggacacagtgaaatatttcttgttcaccattgcccgcaatattgtaatcgactatatccgtcgttattataagaaacaggagatagacagctatatctatgatactatgtccacttctaccaatgaaaccgaagaaaaaattatcggtgatgatttaatgacaatggaacggacccgcttggcagctatgcccgaacaacgtcggttaatttatacattgaaccgcttcgaaaataaaacgtctccggaaatcgcaaatgaactgaatttaagttgcaggacggtggaaaaccatctgtttctgggacgtcgtgaaatgcgcgagtttttccggaattgtatataatcttattcattaataaataaccctttgtgcttatggaaaaggagtcagaatttacaaagaggtacttgtatgcctcaccttattttagagaacaaaaatttaatactatttttaaacctcaaatttaattttatgaatgatatcttaaaatgttcgccgaaaagatttttattttcaatggtggttgcttctgccttattgacaggaataccccagaagacttatgcagaagttgacaggtcacaatctgtgatgcagactgtgactgtgaagggaactgtgttggatgcaaataatgaaccaataattggtgctagtgtgctgatgaaaggaactactaatggtacaatcacggatatagatggaaactttacacttagcaatatcaatccggggactttggttgtttcttatattggatataaaacaagagaaattaatgtgaatggtagcgcacctgtgaaaattatattgcaggaagattctgaagttttggatgaagtggtggttgtaggctatggtacccaaaaaaaatcttcattaacaggtgctgttacggttgtaggagctaaaatgcttcaggaaaaaggaggactgtctagtccattggaagctttacaggggcaggtgccaggtgtcatgattactcgtagttcctctgctccgggagatgagagttggggattgagtttgcgcggttcagtgtctgtgaatagcacagaaccattaattatcattgatggtgtggcgtatgagagtgtgaacgaacttcggctgttgaatcccaatgatattgaatcaatgaactttttgaaagacggtgcggctgcaatctatggttcacgcgctgccggtggtgttgttttaattactacaaagaaaggtgctgaaggtaaagtaaaggtagagtatagtggtagtgctactttgaagactgttggtttgatggcctctgctatgaatatcgaccaatgggcagatggtgtaatgacagcattgactaatgataaaaagacatctgacgtatggtatacttatgccgaattagcgaagaaatataaaggttcttatcttgatatgcgttacagtcctaatccattcggctcaaccaattttactgatgttgctgattttgtatttacggatgatgtaaattggctggatacgctttttggcgatacatggagtacagaacatagtttaagtgtttccggtggttcggagaaatcatcttatcgtatttccatgagttatctttatgatggttctaccttgcaatttggtaataacaacaaccaacgttataactttcgtatgaacaatacgtataagtttactaagaacctgaaattagattcttctatttcgtataatcgtcaggaacaagttgcgccaacgcagattgaatcagctttgtctgccactttacctatgcccggtcttccttttgaatcattgaatggaaaaccatatgcttggggaacatggggatctcctgcagctgttgtacgtgatggaggcgacaataaactctctgtttctgctatttcattaagcgaaactttgaattatcagatttttgattggctgtcagctaatgccaatgtaggatatagtacaagtacggcagctcgtaataaaacaacaaacgctgttactttttataattatatgggtgatgtagaggtacggacagacccaagccaggcaaactcaacttatacacagacaagttcacgaacggatttttactctgtctccggatatttggcggctaataagacatttgctcaaaaacataagctgaatttgacgttgggcgcgcagtatgaatttaaagaatacacttatttcggtgtaatggttaaagatattcagaacggtatggaaatagtaaacggttcgggggatgtgactctgactggtgatgagaagaagtatcagaatgcaaacctctcttatttcggacgtttcaactatgattatgatggacgttatttgttggaattgaatggacgttatgacggctcttctaaattcttacctgaaaaccgttgggatttcttttatggtgtttcacttggatggcgtataaaagaagaatcttttttgcagaaagtcgattggttaagtgatttgaaattacgtctttcctatgccgaagtgggtaatcagagtggtattggaaattatgatggcgtacagctctataatctggttgcggctggagatgatggtgcatatattggttccaataagctttcttatattaaaacaaatggaactctggcctccactacacgtagttgggaacgtattaagaattataatataggtgttgactttggctttttaaatggaactctaaccggttctgttgaagcgtttatgaagcataataataatatgttagtgaatgttacttttccggggacgttaggtgattctgctccgaaagctaatgccggaaagtttgaaggttggggatatgaaggtcagcttaattatcgtaaccggattggagacgtaaattatcatgtaggtagtacttttacttttgcccgtaatgaattagtcgactatggtggtacaactgtgttgaaatcaggatatgtacaaacacagcaaggctatccactaaattcaattttcggtctgcgttacggaggtaaaattcaaaacgaggaacagctggctgcttacaagactaagtattataataataatggtattggtatgccatctaacttgcgtgtaggtgacaatatgtattgcgatgagaatggagatggtgtgttggatgaaaaagattatatctatttgggtagtgatactcctgaaatatcttattctttcaactttggcgcagattataaaggatttgatataaatgtcgtttttcaaggagctgccaatcgatttgtttatcgtccgattgataactggactgttccattccgtagtaattataccaatacaagcactgcttctcttggtaacacatggagtcaaaataaccgggatgcttactacgctccatatactaatgaaagtaatatcaataattataattatcaggcatcttctttgacagcgcaagacggccgttaccttcgtttgaagaatgtgacaatcggttatacgtttcctgccaagcttttgaataaaacaaaagcgatttcaggtgcccgtatatatgtgacaggagcagatttatgggagaccaccaaaattaaagatggatgggatccggaagcatcggctcgagataccaataatactactcaagctgctaagggagtgaaacgttatccgttcactcgtaactttaccattggagctaatttaaccttttaaataattgataatatgaaactaaagcaatatataaaagctgcatgtcttttttccttcatggcggtaacaacttcctgcatgaatttagaaccattgtcggatttgggtgataatctggtgtggaacaatgctaccaatttccagttatttgccaatcaattttatagttggcctcatgacttcaaccgtgctgtatcagacgagcctcatagtgattttcgttcagatttagtggcgggttcatctatgaatgtgtatagccagggtacaaatgctattcctgctacagatgctaattacactagactatataaacgtatctattatactaacctgttgttgaagaatgctgaaagttttgctgtacctgcagatattgcagtgcctgttgctgaagcaaaattcttccgtgcatatagtcattttgagttggtgcagctttatggagacgccatcgttcttacgcaacctttagacttggactctgaaatattgtatgggaagcgtaatgatcgcggtgaagtgatagatcaggtaattaaagatttgaaggaggcagccggcagtttacccgaaacgtcttccgaagccggacgattgaataaatatatcgcttatgccatgttgtcacgggtagcattatatgaaggtacctggcaaaaatttcatacaaatggaaaagatgctacttcaaatactactcgcagcacggaactgttgactattgccagggatgcagctaatgaggttattaaaggtggtaaatataaaatcttctataatgaaaaattagcgaatgagagttatcgttatatgtttacgttagaagatggagcacaatgcaatccggccaacctttcaaagagtgataatacagaatatatctttgtgaaacgtcatcgtaatggagataaaacagcatggaatctgactcacggtatggtggcaaatgcttgttatgtgactcgtaagttggcgaatatgtacctttgttctgacgggttgcctatagggaaatcatccaagtttcaacaatatgccggagtaactgatgaattccaaaatagagataaccgtatgggaaataatatgctgtatcatggacaacagtattggaataacgatggaaaatggcgtacaacctggacagatgcagatttgacaagtagcctgaccgctaatgtacgttctggtagtggctatcaaaatcgtaagtggggcacagaacgtcagttggaagattattacgaatcttatgacttcccggttattcgttatgcggaagtgctgctgaattatgccgaagctgtttatgaactaaatggtactataacggatccggaattagattattctttaaatctggttcgtcttcgtgtcaatccggatatgccaaaattgagtagcaaattggtttcggcaaacaatctttcaatgcgtgaagaaatccgtagggagcgtactgttgaacttgtactggaaggttttcgcattgatgatctgaaacgttgggctactgcacctgttgagatgccacaagatcagcttggagtgcaagttacagggacttggtttgaaaccaactggactgatcataaacgttcgcttagtagtgacggctgccttatactctatagtgatcgtacctggaatgataaactttatctttatccgctaccttctgaccagttgcagttgaatccacaattggaacagaatccgggatggaaaaactaagatgtattattgtaataatgaataaaagaaaaaacgtatgaaacagatattaaaatatgggttaggttgtctgtttatgacagcggtcgtttccacatttctgtcatgtgatgataatgatgaggtatctccactatctaaagcgatttatcctaaatcggtagaaatgattatttcagaagatttacaacaacttatttatgtggatgacacgaaagtgaaagtcttgcccttagtaaaaggagagaaaatagagttgggctataatataactcctgatgatgttacttataaagaggtaaattggacttccagtaatgcaaacgtagctacagtagatgctaatggaacagtaaatgctattagtggtgacggtacaggtgtagcggtgattcaagttgcccccagtgtttattattcgggtagcgatgtggctagtgctttgaaagtgttggttgtgaattcactgattagtgcggagagtattacgattacttcaagtgcagataatgtatatgcaggagaaactgtacagttgacagctgggattttaccatctgacgcgacttataaaactgtgaagtggtcaagttctgacgaaactgttgctatagtagataagaatggagttgttacaggtttggacagcggtaaaggtgcggctgtgcccgttactattactgcaacttctttagatggcgcaaatgtgatcgcaactaaagaaattatcgtgaactcaattgtacaaccggaggaggtagctattgaccaaaattactcatcgactaatggctatgaatttgctattgcagaaaagagcgttgctttgaactttacaacagtgccggagaattgtaccaagtcattgatagagtggacatcaagtgatgaaactattgctacggtgaaggcaggtgttgttactttcaatgcgaatggagtgtttggcaaggttactataactgccacctgtccggaaacaggtaattcttcgtctatagagttgaatttggcagaaggattaatacgggagcttttccgtaatgagaattatacatgggctaatgcttcaaatgcggaatcacatacatggaataaagatggaggctatataacgatcaatacaaaattaaccggtggtaaatgccgtggagatttgatttgtaagagtacaacttcttggttacattctggcaattatcctattttcgcagttcgcatggatgatgtgaaagattatgagggagtaactgcacgtaatataactcttgacgcatccgggatgtgtgatggtactaaatattccggtggtctagacggaaataacaataaatggctgaatgattataaatgtagcgatggaagtcatgtgcttatttatgatatggccagtcagaaatggggtacaggtggtttactcccggcaactgctgttgcatcgtttacaactcttcaattcaaatatgctgatattgtatcgtctacagctgtaagttataatgtttactgggttcagacgttcaaaacattacaggatgtgcaagcatatattaagtcagaagggctgacttatgaagtgataaaataatagaataataaattaaggctcaaaatagattctttatgaataaaaatacaattaagataatggttttcgcactgctgatagcagtgcagagctcctgccgtgagaatgaattcggagtagtggatttgacactcccggaaggagtatatgttccggtagaagctgaatatacttacaatcatccttgtgcgatgtttaatcaggcagattttgatagggtaaagaaaatgctgaatgatgggactgcacctcaaaaagtaaaggatgagtttgaaaatctgaaaaactccagttatgtatcagcttcttcctataccccgcaaccacagacaaagattgttcgtggtgatgtaactggaacgggatttagtagtgaaaactacagctatgctatggaggatgctgcagctgcttatcagatggcgcttttatggaaacttaccggtactgaacagtatgcaaagaatgtggttaacattttgaatcaatgggctgcaacctgtacggaagtgacttcaaatgatgctaatcataaattagcggcaggtgcgcaaggatatacttttgctaatgcggcagaaataatgcaaacctatgatggttggacggaagcagataaaacaacttttaaaacgtggatggtgaaagtattcgcttctaaaaataaagattttctggataatcatcaaggtagtaacaattgtgctttacattactggtcgaattgggatttagttaatatgtgctcctatttgtctattggtattttaactgaagatgatgatatggttaactatattgtgaactacttttataatggtgttggcaatggagctctaaataatttaatccagggtactcatgttgatccactgtctggtgaagagatatgtcagaatcaggaaagcggacgcgaccaggggcatgctcaaatgtcggtagccgtaacagctaatctttgtcagatagcttatacattctatcaggataataaagacatttcccgactagatttcttcgcggctaataataacgcagttatgaaaatgggtgaatatgtagcacttagcaatgcaacggatggagtgaaaaatgacaattcggatggtacatggctgattgatataacaaaaataccttttaaagagtatcagtactgtacacattgtacatgtaaagataaaaatcacggacaagatcataaggtagtatctgacgatggtcgtggggaagttcgtcccggatgggaaattttctatactcactatgcaaagattaagggattgagcagtggttataagtatgctcaaatactggcggataaaatgcgtcctgaaggtggggcaggagagactgctaatcgctatggttctaatagtggcgcttttgaccaattgggctgggctacgttaatgttatatcgtgaataaaatgggtatgagtttttagataaatagaaaaaagttggaaagggattaggtatttacctaatccctttcgtatatataagtaaataggtcagtaaatagattgttttgaaatcagagataggattcagttttaaaagtgcttggtttttatataaggtagaaagaacctgtttttaggagtaacgaatctagttttgaatgaaattgattagtaaggtatatgcgtaaaaagattctgtttttagcaggaatgatggcttgcagttcattggcaggcgcacaagaaatttctaagacctgggtggctgataaggggaatggaacttatcagaacccggttctccatgctgactattcggatccggatgtctgtgcggccggagatgatttctatatgacagcatccagttttaactgtattcccggaattcctattcttcattccaatgatttggtcaattggtcactggtaaactatgcattaccggttcaggagccggaaaccttcttcgataaggcacagcatggcaaaggcgtatgggcaccggccattcgttttcataacggagaattttatatttactggggggatccggattatggaatctatatgattaaaaccaaagacccgaaaggaaaatggagcaaaccggtattggtgaaagcagggaaaggaatgattgatgcaactcctttgtgggacgaagacggaaaagtatatttgatacatgcttatgccggaagccgtagtggggtgaacagtatcctcgtcatttgcgaactgaatccagaaggaacagaagttatttccgatccggtgatggtgttcgatggaaatgatggaaagaatcataccgtagaaggaccgaagctctataaacgcaacggatactattatatttttgctccggcaggaggtgtcgcagccggttggcaattggtacttcgctcaaagaacatctatggcccttacgaatcgaaaatcgtgatggcacaaggaaagacaacgataaacggacctcatcagggtggctgggtagacaccaacacaggagaatcctggttcgtccattttcaagataaaggcgcttacggacgtgtgattcatctgaatccgatgatgtgggtaaatgactggcctgtaatcggagtggacaaggataaagacggttgcggtgaacctgtaacgacttataagaaaccgaatgtgggaaagacctatccggtagctactccgccggagagtgacgaattcaatagccggcatttgggattacaatggcaatggcatgccaataaaaaagacacttacgggtttactaccgatttgggatttatccgtctttatgcaggcagcctttcgaaagagtttgtgaacttctgggaagttcctaacctgctgatgcaaaagtttccggctgaagaatttacagctacgaccaagctgacatttactgccaagcaggatggagaacaagccggaatcattgtgatggggtgggattacagttatctttctatccgcaaagcgggagataagtttattctgcaacaagcagtttgcaaggatgcggaacagcagaaccctgaacagataaaagaattggcaaacattccggtaaaatatttgaagatgccgggagtagcagataatgaatggcaaacagtttatttacaggtaaaggttcgtaaaggagctgtttgtacatttgcttatagtctggacgggaagaaatatacgacagtgggagagtttttcacagcccgtcaaggcaaatggattggagccaaagtcggactattctgtgtgactccgaatgaaggcaatcggggatgggcagatgtcgattggtttcggatggataagtaattgaccaatcaataattgacaaagagaaataaagattaagaattaactcgaagatatcagattaagatgaaaaagattgtagtaggtttggctgtgatgttaggtttctgtacgtgtgttcatcagccgtccggtacattggatgtgaataaggcattggactattgtgcagagcagacacaacgtacgcttgcggaactgaaaacagactccggcatcgactatacaatgatgccacgtaatatcatgactgacgaacaccattggaattgtcggaaagcgacgaaggaagaatggtgtgccggtttctggcccggagtattgtggtatgattacgaatatacgaaagataaacagattcaggaagaagcggagaagttcacgaactctctggagttcctttccaggactccggctttcgaccatgatttgggcttcctcgtgttctgtagctacggaaatggttaccgcctgaccaagaatccggcttacaaacaagtgattcttgatacagccgatacgttggctactctgttcaatcccattgtaggaactatcctttcatggcctcgtgaagtggaaccccgcaactggccgcacaataccatcatggataacatgattaacctcgaaatgcttttctgggcagcgaagaatggtggaaatccttatttatatgatattgccgtttctcatgctgataaaacgatgaaatgccagttccgtcctgactatacatcttaccatgtagcggtatacgacaccattacaggtaatctgataaaaggagtaacccatcaaggctatgccgacagtaccatgtgggcgcgtggtcaggcatgggcaatctatggatacacggtagtttatcgtgaaacgaaagatcctaagtatcttgatttcgcgcagaaagtgaccgatgtctatctcgaacgtctgccggaagacaaggttccttattgggatttcagtgcaccgggaataccggatgctccgcgtgacgcttctgctgcggcagtggtggcctctgctttgcttgaattatccacttacctcccgaatggaacaggaaaacgttataaagatgcagctattgaaatgctggcaagcctgaactctgacagttatcggagtggcaagagcaaaccgtccttcctgcttcatagcgtaggacattggccggctcattccgagatagatgcttctattatttatgcagattattattatatcgaagccttattgaggctgaaacgtctgcaagaaggacacggggtattgggataacagtattaccgggcttatgaatacggtaatatcaaagtatcggtagaactaataaagtgaatagtccgattagaataggtgatagtgtaaaaaaggaaaagctctgcaagaacgaaggttctatgcagagctttttttactggttagggttaggcttattattattttaccttgatgatgtcataattcagatcgctgacagcttcttgcaagctatcgttcaccaaacgaagagtggtgtcgttaacaaccacgaaatacatcggagcttcaccatccttcggagttaacttaacagcagtaacaggttttttgttcacaaccttgtgtactgtttgttgttttccttttgaagtgaaagtcttgttttgtccttgaccttcagcatcgaggtaagtcatatccagtgtatacgcagtatccacaccgtcagttgcagcgttcagggtcagtacatagtcaatacccggaccgtcggcagcaggaagagtaccttcataaacttcagtcaattcggtaatcggagtcatcgcaagagctagactgtctgcttgtgcctctgcggctttgtttgcttttgattggcatgatgccaaagcagctacgactgctgctaacataattacttttttcatcgttaagtgctttaagttaatataaatatagtgagctattgctcgttttttgctatcctattcctgttcatcgtcccgtttgatgacaagcagtttgtctactcgtccgcggtccatgtccaccacttcgaattgcagattcttgtaggtgaagatgtctccagctttcgggatgcgaccaatcaggaacatggccaatccacccagagtggtgaagtcttccgattccagatcttcgtaggataggatacccatttcctccatgaagtcgtcgatattcattgaagcttccaccagcattgaaccatcctgcctagtgacgatttcttcttcttccatttcatcctcttcaaggatgtctccgaagatactttcggtcaggtcgtgcagtgtgataatgccttctgtgctgccatactcgttaacaacaactccgaacttgtttttgttcttcttaaatagctctaaaactttatttgcatacaaactttccggaataaagaggggaggacgggcaatttcgcgcaggttaaacacctttttgttgcctaccatcaggataatatcctttacggaaaccacaccgataatctcatctttccgttcgtctaccaatagatatttactgtaatgttcttcttcaataatcttcatcaccttttcctgtgtatcatcgggatgaaggataataagatctctgcgatgtgtcatcagttcgttggcgcgtttatcagagaaacggaatacgtcgcgtatcatttccgtttcctctttgtcaatcacaccctgctccgaactttggtgcaggatcattttgatttcttcctgtgtcatggggcgttcttcgcttttcagaccgataagtttgttcagtaaccgggtagagacgcttagcaaccacacaaaaggataagaaaccttcgtcagcagaatcatgaccgggctgaacaaagtggcgtaccgttccggattactaagagcaatggatttaggaaccagctctccgataatcagagaaagataggtgatgattgctacggtagtaatcattgccaggttgcgtgcgtatgcttctgcgcccggaatgagagaaaagaaaggtacgaggtcgtcggcaatagccacaccaccatacgcaccggatacgataccgatcagcgtgataccaatctgaatggtagacaagaacttttccggttcttccaattgttttaaaactcctcgggctgatttgttgccttttgcgacaagtgtttcaagacgtgctttgctggatgataccaacgcaatttcatacatggcaaaaatgccattcagtataagtaagaaaagtatgataagaaattccataaatggatttaaatggttatagggtcgaaattacaagaaatcgggacactatgcaaatatgtgtaatatattaatgaaaatttaataatcgtgttgtcttttttgtgtaatcataataatataattgaggcacggattacgcagatttcacagtttcaattaaataagacctgtgttaatccgtgtaatccgtgccttaataaaaatcaacaggaagttttgaactcttccttatatattagataaactctttacttcttagcgtagctgtctgctttggcttttgtacgttcaatgcgcttttgagtgtccggatgtgaagagaacattctttgtgcataggatgctttaggagcatcttttgcaagttctgccaatttactcaaggcatttgccattgcataagggtcgatgccgttttttacacagaattcaacaccataatcatcggcttcattttcttgcttttgtgagaattgtgcaccggcaagagcttctgccatggctcccagttcggagtctgtcagtttggctactttgtcgttggctgcacctgccgcgttcttcacagctgaacgtaggtaggcatttttcatagcgtctttggaatctgtgtgaaccacatgaccgatttcatgacctaccactgccattacttcttcatccgtcataacatccatcagaccggcgcagatacgtacactaccgtcaccgcaggcaaaggcgtttacgtctattacttcatatacgccaaagttaagtttcagtccgtccacttctttgatatgtcccgtcagtttctccaaccgtttgccgtattcagtatcaggttttgtcaatggattatgagtgtccatccatgccatatattccttactcatattagcaatgtccgcatcagataacgtaacggctgatactacatctttacctgcttgcaaagcttttcctaaattaatcttcttgccgaattgtgcagaagctgtcattcccatgcctaataatacgaaggcaatcatagcgatttctcttttcatactctttttctagtttaatgttctatgcataaattaatactcaaatgttattcctaatgtggggagcaaagtcccgctcgattgtttgaggcgtttcattttatagtgttggctgtcggcaggagcttccggattctcgatgatgccggtgctcatcagcacatcctgctgtttcagtttgctggccgtgatattctgcaaatcaagatagaatcccagcatgcaatgtttcagataaaatgtcttgtcaatgcggaggtctacctgtgcaaaggccggaagacgttccttattatatttcgaatagtcgtaatatgctttgccttgtgcatcccaggcggataccaaagatgatttttcttcatcgtatggggtataaggagcaccgccgatgcaactgactttcatgccgacactccattggtggggcagattgtaagttccccgtaaattgaaaatatatcggttgtcccatgcggatgcgatgtattcgctctttttgtcgttgcggtattcacttttaaagatggtgaaagaggaagccagattcagtttcttggcgatcagccattttaccagaatctccgcgccatacgaacgtccttgagcggtagaagtcagcaactcattgccaatcactccatagtcatttcctttgcaggtaagaggaatcccgtctacaacggagagcggaattttgtcatagtctttatagaatccttcgacggagacttcgaacgtatctcctttgcgccaactaatgcccagactttcttggctgactttcatatagcgcagattgtatttgttgacatacattccgttattatctttaaaaccgagtgccgtgtaaggaggcaactgataataaagtcctgcatttccgcttacgaaccagtgctcggcaagttggtaggaaagcgatatgcggggagaaagctggtcggagagtgacttcatggccgacgaataattgttggcatcagctctcaatcccaaggaagctgtgaaacgttcgtccatcgaagagtagctgatagtgccgaaaagtccccaacgcatcattcccaaataggtatggtaatcaaacgtttgtgcctgattggtatatgccttttgaaaggtggtattggtatattgactataatccagattcactccgagattgactttccagttgcggaaagaagaattgttttcgaagcggaacttcgtttcctgttcggtagaacggaagcggagcatcagattctccggaatgctttcatcattctgccggtatttggtattgcggttgttcagataactgtgactgactaccaccgattgcacatgcggccctgcatagtgacgatatacagcacctaaggtaaacgtttcctgcttgatttttggcaggtaactaaggatatattcattgtcctcgctatctgctttcgtgttcaatcgcatattgtcgattcctccaagccccaataccgtcaattcgttctgttcgttgaaccgggttttcaatttgaattgtgcatcggtgaaagtcggcaggaaaggcaggtcgagcatatcaaacaggaattgcagataagattgacgcacggatactagatacgaggtcttttttccaatatgcccattggaggccaaagagacttcggatgctccaagggtagcttttagtgagttatgctccatgtctccgtcgcgcaatttgaaatcaagcacggagctaagtgcgttccctctatcagtgggaaaagcaccggtatagaaatttacttcacgtatcaggtcggcattaaggattcccaccggaccgccggatgctccttgcgtgctgaagtgattgatattgggtatttccactccgtccagatagaaacggttttcagaaggagaaccaccgcgtacaatcaagtcattgcggtagccgataggagagaaggcaactcccggataagactgaacaatacgcgaaatgtctcgattggctcccggactcttttctatttcctgcaatccgatgatgcgcaggctgaccggactttccaagtcgcgccggaaaggagaagcggtgacggttactcctgcgagttcggtcaggttctcttccatttctatcgaaatgttcagatctttggtagataagatatattcgggagtagtgacactcttgtagccgatggctgtcgcttgcagacggtagatgccgggaggcacttgttcgatggtgaaatgaccttccgcattggtgacaccacctttattcagcccaagaaccattacgttaatgaattctaatggctgacggctgtttttctcaatcaccgttccctttatttgatgtacaggttgtgcctgtaacagggaaaacaggatgttagaaaatagtagcagtgtcaatagttttttcatgtgattgccaattgtcggtgcgaaagtacgaaaaaagtattaaataatgataccttccgtgaataaaaaaagaatcacttctgatttggttcgttttacctgctgataaagttagtcgggttttgtttcacatttcatttttatatcttatttttgtgggacatattaaaacagattccttatgaagactgtaaaattgataacttgtaatgatgcgatgaaggcacatatccttcagggagcattggagaatgaaggcatcgagtctattctgcacaatgagaatttctctactttgtataaaagttgcgtaagtagtatagcaggggtggatatattggtggcagacgaagactacgagaatgctgtccaagtgttgaaggataacgatagttggccggaagagttaacgctttgtccgtactgcggttcatcggacatccagttggttttgagaaaagaaaagcgttggcgtgctatgggggctgctatcatttctgcattaatggtcattcctccgggagacaaccactggaactatacctgtaaacagtgtcataaaaactttgaaatgccggttgctaaatttaatcctgctgcagaaccagaggaataattatatctaactatttataacacacaatggaaaagaaaaaaaatctattaattgctcttcttttaatttgggtagctccctcttttgctgccaaagtagataccttgttaattaaaagtccttccatgaataaggaagtgcaagtggtcgttgttacgccggatgctgcatcaggaaagaaagcggtggcttgtcccaccatttatttactgcacggttacggtggaaatgctaaaacatggattggcattaaaccgaatcttccccaaattgcggacgaaaaaggaatcatattcgtttgtccggacggaaagaccagttggtactgggatagtccggtcaatccgtctttccgctatgaaacttttatttcgtcggaactggtgaagtatatcgacgaacattacaagacgattgccgaccgtaagggacgcgccatcaccggattgagtatgggtggacacggagcgatgtggaatgcaatccgtcataaagatacgtttggtgccagtggaagtacaagcggagggatggatattcgcccgttcccgaaaaactgggacatggctaaacagttgggagaatatgaatcgaataaggaggtatgggataatcataccgttatcaatcagattgataagatagagaatggcgatttggctatcattgtcgattgtggagaagatgatttcttcctgaatgtgaacaaggatttgcataaccgcctgttggaaagaaagatcgatcatgattttattacccgcccgggagcgcataatggacagtattggaataattccattgattatcagattctgttctttgataagtttttcaagaaataaaaccgggaatacttgactttggcttttcaatgttgtatctttggtacagaatcataaaatagattgaggttaaactacgatagaaggagggagcggaagctttctccttttttgttgtatccttgggagtcgtgagctttatcccggtttataaaagggatgaaaccagagattaacgtgttttataccgtagctttataaaaattagacggtgcgttacgactcattaaacgctgcattaggagaagttagagcctttgttaggtaaaatcagagcctttgtttcggaataaacaaagttgaggcatgaaaagtatctttataggttaagaatctataattctgctcttgacagaaatagagtgattatgctactttaaaagagaattcgatgtccgaatgaaagattattcgaaagaaatcgaaatgttgcgtgtgtatggataatagctggcctgtcctccggcataggtcgtctgacaaatcatcctggatggatttccttttttatcaaacccatacgaatagactgtcttttcgtcgttacttcctgcaggacaactgtgcatggtgaaatggcgcggatccttacccaataaccctgcgtaaagagcttcaatatggaatgtcagagggtgtatttccaataaaccgaggcagggcaaatgatatgtcgaactttcttctcccggttcataaatgaacttgttttcaaggccgttcatcttggaactgatagaggttatatctccgttctcgtatgtaagtgatgttgatgaatattctgtatcgtcaatattctcgacaattccggttaagtatccttctgcagagtaagaaaattgataaatacgattttgtgaagacaaactgtatacacattgactggcatagccttcgctatttaatgtatatactaaagtgagatagtcagtggtaactgttacctgattatcagagtagctcaagtttacttcgttactgatttcttcttcgaaataacgttgttttataatatgttgaatcaggcgctcgccatcgaacataaacttctctgttctatctacaggatttgaatcgctcttgacggtttcattgaaaatcatagcccattgccctttatcctctactgtgcccttttcgtcatcatccgaacaactgaatgtcagtattgccagcaataaaatagctatttttttcatcctttcttattttaatcgtaatccgttactactaaaacgtctacttgccggacttattacgcttttctctatcttgaattgcgcttttgtcgtctcttcggtttcctcgtcctttggtggataagttttgttcaataccccgagagctacactcaacaaagtctctttttcatcaccgaaaggtaggaaagttaagtaatcggttgaagcattgactgcgtatgtcggtttgaatccaccataagtgtcatgttctgaattatagatagtgcatacagccggattgatagaccacaaaaattcttcattgataaattgttccgtagctacattttgtcctttggttgaactgccgatagctattaactgttggatttttccgttcaggctatgcatcaacatttccggagctcctgccgtttctccactaatcaaaacgataagagtcgttaaatccaggttcttgccaccggaggtgcctaataaatcagaattaaagatcagagttgcatcttttgccgtattcttatcattatattccaagaatgccattgtttggtcaaggtaaaaagaagacacaagaatagtgcttaatagttgcgtacaatcaatgcttcctcctttgttatatcgtaggtcgagtatcacttgatggatattcttttgggcaagctcatccgaccattcacgtaattcggtgttgtatttttccggattgtctttagtacctgctgtaaagctgttgtacattaggtaaccgacttcacttccatcagtcaacgttaatattttcttgcagtgaatagggttgtctaccaatgatacagctgctcccatttctacagggtcgcctaccggtacaactcggtaaatatcttcttcctcctcgccttctactggcggctctgtaggtggtactttttgatattttcccaaagttatttccaaaggtcctgtgccttgcagtagttgggcctcatattttttgctgatatacgatgtatctacttttacaatccagtcgcctcgctttagtacggcagcagctggtgaaccaggaattacataagtaatcaatgcgttgtaggcagtatcgatgtccgggttgcgaaccagtgaatagtcgaatccataagtaggcagcggagcctccatcacagaatctacaaacgagtagctgtctttttttgatttcactttagataagaacgaggcaggttccagaaacagattcacatcatcgtaggaaggtagatcttgataccacagatagttctgttgcatgatgtcgtacatccatgtatccagtgcagtttgatgggcatactccggccagcggtcgacaccacaggagaagaaaccactgatagatacgaggatcagggcaggtatgaggattatctttcttaatttcgtcatcataaaaagctttttactgtgcaaatgtaggaaatactttgcttatctaccacatttatggtataaaaatgccttcaatgtgtgattgggtgttagagaatcttgccttatctttgtaacatcaaagttttcgataggtattagctaaaatatagaaagttattaatagacggatttttattcatggagatagctgcattattatcaggaggtgtcgacagttcggttgtcgtacatctcctttgtgagcaaggatataagcctactcttttttacattaagataggtatggatggagcggaatatatggactgttcggcagaggaggatattgaattatctactgcaacggcacgtaaatacggtctgtctttggaagtggtggacctgcatcaggagtattgggagaatgtggcggcgtatgccattgataaaattcggcagggattgacaccgaatccggacgtgatgtgtaataagcttatcaaattcggctgctttgaacagcgtgtcgggaaagatttcgactttacagcaaccggtcactatgccaccaccttacaacgtgatggtaaaacatggctgggcacggcaaaagatcccgtgaaagatcagacagactttctcgcccagattgattacctgcaagtttccaaactcatgtttcccattggagggttgatgaagcaggaggtacgtgagattgcaaaccgtgccggattgcctagtgccaaaaggaaagacagtcaggggatttgttttcttggaaagataaactacaatgatttcgttcgtcgttttttaggagaaaaggaaggggcgattgttgaactggaaaccggaaagaaagtgggtacacatcgcggttattggttccacacaattggtcagcggaaagggctcggattgagtggtggtccctggtttgtagttaagaaggatattgaggaaaatactatctacgtatctcgtggctacggtgtagagacacaatatggtaatgaattcaggatgcatgatttccatttcattactgataatccttggaaaggtcaggagaaggaggtagacattactttcaagattcgtcacactcccgaatttacaaaaggaaaactgatacaggaaggggagaagcagtttcacatcttgtcgtccgaaaagttgcaaggcattgctccgggacagtttggggtgatttatgatgaagaagtaaaagtttgtgtggggagcggtgaaatcatctgttaaatagtttattttgattggtgaagattggattatcaggagatttttcactacttttgtttcgtagaatataaataaaggaggattgcttatgacaacgatggaattgaaaagtctgaaaatggacttggtggaggaactcctgagtttgaatgacaaagagatgctcaatcgagtgaagaactatttgaaacgactgaaaaaaatggaagctgaaaaagaagaggaagaaatcacgaaagaagaagttctagcagggattgacgccggactgaaagaggtaaaactttcaatggaaggtaagttggaggtaaagactgcaagagagttcattaatgaattatgaaattatagttaagccgacatttcagcgggaggctaaaaggttggcgaaacactattcctcttttaaggaggattttgtttcattgattgatgatttagaacagaatcctctgctaggaacggacttgggacatggactgcgcaaagttcgtatgaaaataacttcaaaaggaaaaggtaaaagtggaggagcaagggttataacatttactttagtcgtttctcaacaagatgcagttttgaatcttctttatatttatgataaagcagatagagcgtctatatcagaaaaggaaatagaacaacttctgaaacagaatggattgaaatagaatagagaaaggcactgttcactagtttgtgctaataggatgtgtagggtaattcttataaggcggcatctcagatatagtattccgctaaatccacaatcccagccctcatcgcatatttagtagcttcatgtacattatttactcccaatttgcgaaagatattcttacgatgactgtttatcgtatggaaactaagatttttctctgctgcaatctctttcgtcgtttttcccaatgcaatttcttttaggatattcttctccgtttgtgtcaatagatgatcgtctacgcttgaggcagccagcggagaagaagcgcccgaaagcaacagattgctgacatgattgcaaatataccgttgtttgcgggtggcacattgaatggcagtcatgatttcttcttttgaattatctttcatcactaccccgaaagccatactgctgaacagtacctggcggagaaagttcaggctaagttcgtcagagaatagaatccagtcggcttccttgaatctttcctgcaagacaatcaattcatccgccccggcaaaattgaacagtgtataatccaatacaatcaccgcttgcggatgcaatcgtagctgctgaatcagttcagccttgttatcagcttctaaaaggagggacacttccttttgtttacttagcaggaacatcattcctgccttactgatatcctgattgtctgcgatgataaattctctcataagcaacgatgaataaaaaaactccgctacaaatgtacgcattttgcgcgatttgtagcggagttatgataagattcttgtatccggattaccaggaacgtcctttgaagatatttgactggtcaagcggaacgatatttccgttcaatgtcaggttattgttgctgaagttcgggctgatgctaactgaagcagtattgtttccgctgctcatattgataaatacttgagcggagatgccgataccctgaacgctgaatgagcagttcacatttccttttttgtcgatattcatcttcatatccgaagaattaccatctactgtaacaccaccgattccgttaggacctgggtaaggagtgttgaaagctgtctgtacggtagctctgttgccgttcatcaagacgaagttggtgtttgaagtaacaaaagcactcataccgttgcggaagacaacttgattagcttccaatacaaattgcttgttcttcaaagcctgtacagcttgttgataggctgccatgtcctgcacctcttcttcggcacggagttttgctctttctgcatctctttgagcttttctttctgcgcggcgtgctgctgcgttactttcttgtgcatacatcattgtgcttgcacttactaatactaatgctactaatgcaataaactttttcataacttttttttgtttaggtttaatacgttgttcgtttattgcaaaaacaaagtgtatgccagattgttcacgaacgtcttgcaattttatatccgatggctgccacagtgatactcattaaggggctgataatgttgaaaaaacaataaggtagatagacaagtgtgggtacactcaagatagtagcttgtgtcattccgcaactattccacggaatcaatacagatgtaacggttactgcatcttccgtcgtacggcttagtaagcaactttcataccctttcttggcataaatatcacgaaacatatttcccgtcagaatgatactgatgtattggtcggcagttgtcagattaagaaacaggccggagcagactgtcgctccaaccacgctgactgttttcttcatgaagcggacgaagatggaagtgatacttcccagcataccgcttgctgtcattgccccgccaaaacacatggcgcacagaatcagccaaatcgtattcatcattcccgccataccacgtgtggcgattaaatctgtcagaacggcattgtctgtatgtaaatttgtcgctccatagacggtcatcatcagtcctttgaacaaagaatcgaatccggaaacggcaactccggaaatctcttgcaacaactccggctgaaatatcaaagcaaagacaccagcctgcagagtggataggaacagcgtaacgatagagggtactttccgtgctatcagtattccggttacaacagggactattaacaaccacggagtgatatggaacttttcattcaaagcggttgccacctccgcaatatgttgtgtattgctggcatcgtgggaaagtcctgccactgtgaaaataatcagcgtgatgataagagacggtaccgtagtaatcatcatataacggatgtgacggaacaggggagtgtctgtgatggaagacgccaggatagtggtttcggataaaggagatattttatccccgaagtatgcccccgaaatgatagctccggcaatccatccatcttcaaagccttgcgcctttccgatacccatcaatgcaataccgatagtggcaatagtggtccacgaacttccggtcattacagaaatcaacgcgcagatgatgcaggtcgatgccaggaagaaactgggatggataatttgcatcccgtaatagattaaggtcggcactactccgctaatcatccaaatgccactcaacgcaccgattatcaacagaatgatgatggctgttgccactccggcaatattgttggtgatggcgagctcgtaatctttccagggaatcttataaaacgccataccaatcaggatacaaatggctgtagtggtaagcaatgacacttgacttccgccgcttagggcatcactgccaaaggtacggatagtggcaaacaataataacaccagtacaacaatcggtatcaacgatatgaggggagagggggctttcttcatcttgattcttataaccttttatttattttccggctactgtttgttgatagccgcgcaaagatacaacaaaaaagaatgaaatcttttgcttcaaaacatcaggtaataaaaattattagatgtttatatttgattggaatatgtaggagacggctcaactggcaaaagtcttgcgcctgatccaccagtaacggatgaaaagcacccctgtcaggatgagggcgatggataatccggtatagaaaacagaaatgaacgtttcgggcaggaggtggaagctacggatggtgattcccagggaaatcatgaatatcattgtaatccagcttttcacatcgaaaaaggagaacggacaattccggcgttctttcttttgctcgattcgctgggtatgtttatagtagagccttctgaaaaccaatacgaagaataataagaaaaccacggtggcttctcctattttgaacatccaatcttgggaagtgtttaaccaggtcacaattcctattcgcagaatattggcaccggctataatccagacggcaccggctgtgataagtaagatttgtctgttaactccgtatttcattggcgttttttttataataaacggtttgagtgttcgttttgttgactcatttcttgtagaaaatcgtaattaataaagaaatcccggttaaaacaactccggtactgataactccgtgccagccatacagttgccaaaagctgcctgccagaaatgttcccatagaaccaccgataaagtaagtagtcatgaaaactgtattaatacggttcgaagcacgcggatttagttcgaagatacttgtctggttacttagctgaatacattgcattcctatgtcaatgatgatgataccggcgatgataccgacaaaggtgttttcaccgacgaagaacaacaaccatgcaaagagaatcaaaccgcagccgataaagttgaagcggcgtacgcctacccgttttacgtatcttccgacaaaagaagcagtcagtgcaccggctactccgcaaagtcccagcataccgattacatcgctgttggcgaagaacggagcttgtcccattttaaaagccagacaggaccacatggcaaggagggaaccgaaattcagtgccgcccgaatcgaataaatgcgtagttgcggatattctttcactaaggctaacagagatttcatcaggtcgctatattttccttggaagttggtttgaatatcgggaaggacttttaatacaacaatcgcgcagataaacatcatgcctgcagcaatgtgatacatttcccgccagccaatcagttcaccgataaatccgctgacgacacgtgaagccagaataccggtcaatagtcctgataagacaattcctacgtttctgcctttatgttccggacgggaaaactgggcggctatgggaatgaatatctgtggaatcatggaacagactcccgtgaggaatgaagcgatgagtatcagatggaagctgtgtgtcagggcaatcgtcaagagggagaagatcaggacggtgaaattgacaaggatgattttctttcgttgatataagtcgcctaagggggtgatgaacaacagtcctgccgcatagcctatttgcgtgaccatggcaatcaggttagttctgaactctgatatgccaagttcatggcgtatcatatttaatagaggttggatataatagatgttggctaccgagacacctgccacaatagcaagtgtccagaggatggatgccggtagtcctccgttttcttttaatggctgtttcatgcggcaaagataataaaataagatgtttattcgatgaagaaagtagtggaaactgtgttgccttctccgtctactgccgtcagggaatgtttgccgggagcgggttgcagggaaattttgtggaaatcctgcgtctgtgtctgataagtgtcgtcaagatgccaaaagatagtcgcattggggttgctgtgtgccagttcgaccgtgagaaaccctttactgccgtccaattgtttgggcaacttgatatgggcgttcatcggagggtagatgaactgcatggattggaaagaatcttctccacagccggctttgaaaggtggcagtggtttgtattccggatggtgctgcttatagtaccattcccatacaggtggcagggcaaaccatgatttctgaatggtaggttcggtatttgcacagttttcatagatgcggtggctttcgtcagcagatagagtgacgagatgatggtaaggacaagcctctgtccgtaatccggcaggaagaatcaatacggtatcagtttcttcacagaaacgtcctttcagatgaccggactggcggcatatttctgcatcaacgaaaacgcctgtgggacgttcgaaccacggtgaagaagggaggtaactgaatatatcgaataatacaggaccggctgtttgtgcaccaaccaatccgggctttccttctccggttgcattgcctacccatacgcctactgtatagcgcggagtcacccccactgcccacgcatcacggaatccgtagctggttccggttttccatgcgatagtttgcatggatggaattgatttccagtcaatctcttcgggacggttgacttctgttaaggcggagagggtgagccaagctgctcctgttttagccgaagtggtttcttccgaatcctcttctacggagagaggactggagttactttgttctcgtttttcctgcttgttatgattgcttttatgattacggcttgtttgcttcgtatcattgtttatttgctctgtattttctgtttccagtagtatctgtgcttcctttccttgagatacggtcggggaggggctgctggaaaggcttcgtcccatttgtgcataggcattcgttacatcccataatgttgcttctgcacctcctaaaattagtgacaaaccataatgagaggctgtccgattgatggtcttgaattccatctgttgcaacaaatggtgaaacttgggtactccatatctttgtaacatggttacagccgggatattcaacgaacgggcaagggcttcggaagcggggactgctccttcaaactgcatactgaagttttgaggagtaaatccgttgatattaaccggtacatccggcaacagcattttcggcagtaaacttccttcctgtagcatggcattgtagagaaagggctttaaaatactacctgtacttctgggagcttggatcacatctacttggcttcctccttgtttacggtcgaaatgtacatttccgcagtatgctactacttgattggtgggaatgtcgataaccagaattgccaggttgcggatatcacttcgattaaactcgttgctccaccgttctgccaaactctctatgtggctttgtattcctctgtctatggttgaacgggtatatagcccgtttctttcctgatagaaacgactgactaggtggggagctatttgaggaagcggatgcggctcgtcgggtaacggttcgctgacagctaattcataggtggatgcgtcgataatctcttcttcaagaagttgctttaatagacggttgcgtttggaaagcagtgtctttcgtcctttggatagatggatcatggcaggggcattggggaggacagccagcatagccgattccgcccatgataaatcttcggcagaatgaccgaagtaacgccaggcagcagcatccaatcctacaacatttcctccgaatggtgcatgagagacatacatggataagatttcctctttggaagcccgaaattccagacgggtagcccatatcatttcaacgactttctctccgagagttctaggtttgttccgggcgagacgaatggtttgcatggtaagggtacttcctccgcttacgacacgtttgttctttaaattttgatagagtgcccttccggtagctaacggattaactccccagtggtgataaaagtgtttgtcttcaaaggtaatgaggcattgcttgattttttcgggtgttgtctttcggggaggaaaccgccattgaccgtccgatgcgatacgtgctcccaataattcttcatttcgatcagtcacaacggtagagtagggtacatgaaacagttgccggggaaggcaaaagatgtatcctattatcaaaagagtaatgcttatagtcattactttcttagtgacagataatcgtttgaagaattttataggattcatttaaatattaaaagctaagagacatatctttgtgacaaatgattaagtacgaaataataaggtacgaaataattaggcacggattacacggattacgcggtttaagtgaacgagtagaaccgtgaaatccgtgtaatccgtgccaaatattatcggctgacagttgttcttcctgctttgcttcgtgcctgtacgtttacatcatacatcgcttcacattgaacggcagggagaataaagttaccggcataggtcgcttgtaacctgacagtgaatacctttgtctcaccgcggcgcagattgaaataggtcaataccctgtcatcacgtatatcctgatagctgtacttgctgactgattgaccggagccgtcggctgctgcgttttccgtttcgggagcaaccattctttcattgtatatttcccaaccggacggtatgatatgcgtcagtgccagattagtgtaatcggaagtaccgctaatattggatattgaggtgatagccataaagtcagttccctgtatgatgtcattgacagagagcggtgtaccgtttaggttagcatatcttatatccatgcggaggttatcgctgatagctggtaacgtatcgtttaataactgcgtacgtgtgataaggtctacgctaagtgctccctttccttgattcttcacagaaacagtgccggattttggagtggtagcgatctctttttcaaacacagctttggctgattttacagccggttgctgtttatcgttccatgaccatacaaaatccagtgtgcctgataacttttctgccagacgtcccattgccatcagagcaaaagcggtagattgtgtactgaaccaatcctcttgtgacagattcttagaaacgactttcgcttgttgtaaagcatcccgttcccggttcatcaggatgagtgtttccaaaatcattgcttcgtcacgatcggaagaaccgtaaatctgattcatggaagagtaggggttcaccgttgtttctacattatacacaagttcttcagccggtttcatctttccggtcagtgcgtatgcggctgccagtctccatttggcctgaattgataatccggtctgttctttcattcggttcatagctccatattccggtactcctgccaatgcaagggtatataaacggaaggcttgttgcaattccgactgccattgctgccaaccgcttgcctcctgtggcatacgccagttttgtgcggctgcacgttggaagcgcttccacttgttcagtacattcgcatgaacggcatatcctttttcttgtgccagcgtcaggaacattccagcataagaactaatccattcgtcggcagcagcattccccggccaatatacaaatccgccgttggggagctgacgaccataaatctgccggatagcttcctgtacattcgtctttatcttttcggcttccgtcttatctatcgtcttgaattgagcgacaaacagaagaggcagagccttggaagtcaactgctccgtgcaatggtgctgataattgtataagaagtcgaaccgacggctgatatctaccgaaggtatgcgggatacttccagcttgatctgattatttgcggaagaactgcttaggttgtatgacaattctttgctttgtccggcttctatccattgactgttgcgcagggttactaccggattcggattgcgtacgtctatttcaatggtttctttggtttgttgtccgctgccatttgctgtcaggtggatcgtagcctttccggttttgctgcctgtttttaaggtaaagaagacaagctggtctcccggttgggtgaatttgagcgattgttggttagttcctacaatctgtactcctccaccggatgcctgaagggatacggtcacattctttacttgattctccatcgcaaagatattgaccggaacggtaatttcttcctgaatactaagcacacggggcaaagtagacaacatcatcaatggagttcgtacgaaggcagtcttttccgcattgccataagcaccgtcctgtccggcaaccaccatggcacgtaccgaacctacgtacatcggaagtttcaatgtatgcgtctggctctttccttttcccagatagaaaggacctataaacttgactaccggtttaaaacggtttgctttagcatcggcaggtttcagtgtggcgtctccacctgtgctgaaaagcgaactgtagcttccggcagaagctcccaatacattatcatacatatcccatgtctggatgccaagcgcttcgcgtgaatagaaatcattccatgggtccggggtcttgaagttggtaagatccaataaaccgtcgtctacaatcgccaatgtataagtcatcggtttaccgctcttttcgctgacggtcacgttgaagttggtttccgggcgtaacacttccggcatctgtatctgcggttgcaatactgtctgactgttagtgacaaatactggaacaacaccgtacatacggataggcaggtcgttgactgtttgcgcatgaggctgtaacagactgatatgcaaatatacgttcggagtcatctccggcgtaatcttgaatgtatatttcgtatctcctccgttggagacttctatccattcctgacgtaatactgtcgaaccgttttcgatagataccagtgcacgtcctcccgctgctgcaggaataatggctgtggctgtttctccaatttcatacgaatctttgttcagagagaaagcaagcatcttgataccgctgggatctgttttgctcgaacgtccgcgccattccggccagtctatataaacggttcctccagtggcatgtccgctctctttgtcttttacgtaaaccaaatatcgtccccatgacggataatcgatgcggaacttgaaggatgctttcccgcctcttgtctgtaagttgccgctggcaacaggtgtgatggaactgttgttgatgtaagtgccaaaagattcaccgctgttctcccaccaccagctccagccgatgtggtatattttgtattctagattagtacggttcactaactgtccctgcgtgtttacagtcacaatatcgaatacgtgatctttgtccgtttcaatatatttgcctttcggttggttcaagttgataccgacgtaagatgtaaatggcgagaacgggattgtttgggtgtagatgctggcatctcctcccggttcgaatacacgggtggtgaaagttgcattcaacatacccggtgcttcggttgcggtcggaactttcagtgtgacgctggtttttccttctgcatccagtgtaccgtcgaatatatcagttttgatagttgtgaaattcgtggccggattattgaagatatattgtccgtaattcttaaactgtgtattcactttagataaagacatttctattttagctttcaatttggaggcagtggctcctgtcagccaggttgaagtgagtggggcgtagacatccttgtccgtagcttgaagaatcttcggcaatgccaggtttattttcaagcggttgggctttatggtttcgatacgcagacctttgtggaaggtggttcctcctactttaatatatgcattccagagcccggttggatctgtagcctgtgtcggaacgtcgaatgtataaaatccgttcattccttgcgttgaaatcattttggtgtagaactgtcctctcggattgtatatttccagtgctacgggatgcttgtcggggattctcttttcgcggtcctccaatataaaggaaatgtacaatgtgtctcccggtcgccatactcctctttcgccatatatgaatcctttcaatcccttttgaatatcttttcctcctacatcgaatctgctgacggactgttcttcaccgtctacgacacgcacatacgccttttgcttttccgattctgccacgataatgaaaggtacgcccttcggagtgatttcaacgaacccgtctccattggtctctccctttcctatgggctgtaactggaagttatatgctgttacttgtgcttttcctatcggtttggtgtccaaaatattgcttacggcaatccatagtttgttcagtgaattccgttttacaatcatccccagattggaagcaaacacattacatgcagcaattcggtctgaattcatataataagatggatggcatggattgtcgcgttccgtccatcggtacacgctccagtccattgttcctccgttgtaataatagtaagcttcgggcgtattccagatggcttcatcttcttcagacaagacacttccgcttactttggtcaacccgtcggatgtgttactgtcggcgaatttcatatcctgattctcgtttcctccacaaggataagcggagtattcctgacggaatgaaagtatgacacggtatatggcacccggctcctgatgaatcaacccggcaaggtctattgagtaatctccccaatgatgaatatctttggaagcatctttggcaagccataatgttttcttgtaaaccagtcttcccgagcggcgtagttcattggtcgaggcgagtgaattggtttgcatgaacatcaatacattattctcgaagatacgaatcacgctcaggtccacagcatacaggttgacagccctgaaaggaataatcagacttttcgagtcgggcaggatggcggcggaggtagacatttctacttgtggtttcagactaacttcactgaacgagatcgtatgtgaagttcccagcgctttaccttgactgtctttgactccttcatggatattcaacgtcagtttgttctgtgtgtttgcttcgaaatagatgaagactctgttctcgctgatttggaagatagatgaagagacttccggaatctcaatcagtccttttaaatcctgggtagtggataaaggagcggagaaaacaatctcaattccgttttccggttgttcaatgcgttcggcagacataaaacggaagcaatctttagccggtatcagcacttcttcgctttgtttgcggtcaatgccggctgggttaccattggctgtaatggtcaatgggtaatcatcagcttctctgggtatttgtctgatgttgaactgataccgggtaaggttgtctgtcgcggtgacttctaccggataactcttcttgccatcgctggcagtcagcatcttttccacttcctcttttttcactacatcgctgaagcgtatttctcctttaatatttatttcatccggttgggtagctgtaattggtaacgactccaactgcaaagtgaagttacgttcctgcacacggaatgagaagttgaactcttttagttttttgtccacttcgatgaagtctcccagttggaaagttccttcgtagagcgttcccggtttcaatgttccttcttccggcacaaactcaatggtgttgttgcttacccagtatgcttttccttttaatgaaggggaaaagctgaacggattgttttttaactcactgttcagatccaccatgggttggtcatgggtcaactctatgcgtatggttgaattctgtgaaataactcctcccgtatacgcatttacatacggtgcataatcggcagaaggaatgatgtctttttgagtacgtgtgcatgaatataggcccacagtcatcatgataagtaggagtagtccggtagtactaatgctacgtgtagtctttgttagtcccatagcgatgagtttttttatagttcaacaaacaaatatacagtttttatgctaaatcctttgttattctgattatttttgcaagttcttaatcaatttatttatggggaaaaagaaagaatacaaagaggccaatcgacgatttctgaaaaagctgtcatttcaggaaggtgtttttgcgttgccgtgtggaatttattacaaagttttggaaactggtgaaggtacgatttctccgggtgcgcggagtattgttaccgtgcattacaaaggaagtctgattgatggtcgggtgtttgataattcttatgaacgtacttgtcccgatgccttacgtcttagtgatgtaatagaagggtggcaggtagcacttcagaaaatgcacgttggggataaatggattatctatataccttatgcaatgggttacggtattaaatcttttgattctattcctgcttactcgacattgatattcgaagtggaactgcttggagttgcatagaggtgagctatatataatcagatgcatggcttccccttcttccggaataatattattggatgtatggttactatatattaccactattttttgataaatagcgtgtttgcaaatataataaatagataagctactgtaatcttcacgattgcaggaacttatctatataaagtaacttaaattacttgctcaaagcctgagctacgtctacagcacaagcccctgtacaacctaccatcgggttgttaccaatttccagaaatcccatcatttctacgtggggatattcctaaaataataaaatttaaggcaactaattcattgcgagttagttgccttttttgtatctttaagcattccccccaaaaaacggtttgacccttcagtaacggattactggaggggacagtgaataaaattaaagcggtaaaaaggcagatgtacaatagggcaggaagcaaactactgagagccaagattctttattcacaatagaagaagtaccaccaaatttgacgaagaaccattttttcttcataaatctctttttaaattattaaatagccctaaaacatttaaactcactttttacacttagataagttctatcagaacttaattataatccattgtttttgtagtgtttttacatcaaatatgtaattctggaaagaaatgttgcttgattttactttttcaatcaatttagatgactattccataaaaaaaatatgtcttttcgttgttttttgcaaaaagaatatatacttttgttccattatataataccaaaccggaactgttaataaatacaatccgaaaaagagatataatttgtattttaagaactatatatttattttaataagaatagaatataaaaaagcactaagttctgatagaacttagtgctttttcgttttatggagctactattagccattttacttggatttccttcctattctacttttcagttacattataattatattttaaatctccctcaaacataaaataaaatcagaaatataaaagaggctcatttaaactatgttaaatagacttcatctaaaatttcttcatatatgacactctgtatatttctttatatagataaaaacaagtaaatatacaacagtactatttatttacatcaaaaacaaacaagttattttatgatttcaaaatttcgagagatttattctagctttatctcttgattttaaggagcacctcgttgcattaaaaccaacgaggtgtttctcggtgtgcaacgggtcgttcctttaaaaggaacgacccgttggtttaaaaccaaaacccacttatgtaactatctgaaaagcaaatcattacaaaagcgttctcccggcctttctttttaagtaaaattttcaacaaaagaaaacggataccaatatcaaacacggtactccactgataaatattttacaaatcaaatctaaaaacaatggttacagttacttttcagatcaagccctatctagcggcttacatgtacatgcgctacaaaaatcacctcgacgtacctccagaccgctcttcttcctcactttccgcgatccatcttctcgacacccagcccatctaccactttctccaccagctatccattccccaccctcccaacgcctcatggcacgaaaccggaaatattaccttcaccctcccccatcccagaaacggcaaaaatccaaatgtatataattatataggtcataacagtgcacttatcattgaaaaagcaatggaagtagaaatgagggccgaactttatgaatttctactggaaaataaatactgccacggcatcatgttcaaaaaatcaatggaaacttttgtcgaacattataatatggtagggttagtggaagaagaaagtttgatgagggcatttcagaggtggagaaagatggtgaaggaggagaaaaataggtgattcttttatagggtgtcacataaaatgagacaccctgcttttacttttgcaccaaacttcattaataatcaaaacaaaagtagtatggcaataaaaaaagtatcaaatgagtttatggctaaggtccttaacgatgtagcttggaaagccttgtctaacacaagtaataaaatcctttttcatgaggaatgtattgagcattttaaaaattattgggattggtcagaactttcaagtaatactgatctaaagttgaactattatcttattgacaagtttatcgatttatgggattggagtgaaataatcaatcgatattatgatgatgcgtcactctatactatcgactttcttgaaaaatatgttgatagaatacccaccaacaacttgcaaaattcatatttatggtattccatcgtaaaaagacggatgaaagaattggcttttgagattgtttcacaataattattcactacgtgaacaaagaggaaaaattgtcttgctaaagctaccagtagctataaacgttgaaaatatttcaacgttatataaatatcaattaaatcaaaattataatatagaaaacgaggcaatcttttcgtatttttgtattaacaaaatagtttaaatatggaattgaatgatcttttaatggaaataagcaagatttgccttattgagcaagagcgaatgaagcataagcagcgaaaaggcgattgttttaacgttttcaacactcttggattacggtctaacgaagttagattgcattccgcattccttgcagaattgttaaatcctgacggaaatcatggcctaaaagatgctatgcttaaagaatttcttgcagccattggcttaaaacgagattatatatctaattgcaataccaatatagtcgaacgatatattggtgagcggacagaaactactggtggacggatcgatataatcttggaagatggtgaatatgctattatcattgagaataaaatatatgctattgatcaataccatcaattactgcgatacaataactatggtaaacaacgttttccgaaaggctttaagttgatttatcttacacttgatggtcatgaggcaagcaaagattcattaggagacaatgagattgactatcactgtatctcgtacaaaggacatatcctaaattggttatcaaagtgtgtgatgttagcatacgacaaacctctggtacgagagacaatttcccaatatattacacttattaaacaaatcacaggacaagatatgaataaagatagtagtgataaaatcgtagatttagccatcaataatatggaagcagtagttgccttgatggataacagagctgaaataagtagcaaattaagaacagaattcatttttaaaccgttaaaagaattcgcagttaaaatggggatggaatttaagctcatcaaagaaggagacgaaagtccggctctaaaattcaaaatgccccaatggtcccattacatagtcattacaagagatgatggaagagattcggattggaagaacctttatatcggtatttcacaaagttcactgctgggggctaaagaattaccaatacggcaattatcatgtttttcagaatgtagtaatacgtactggccttatggatgggaatggattctatacaccgattggcattccaccagtagctacttaccaatacgcataggagaggtctcaaattggattatctccaaaatcagacaaatcatagaagagatagaagataaaggtttgcctatgtaacaatccgagaaactacaatttatgtcactcatacaaaaatatatttgggtcatagaaaccatttaccggacccgtcaaatctcattaaaagaactcagtgagaaatggatggacacggaaatgagtggcggctcatctatatcgcgccaaacattcgaccgctggaaaacaggtattttagatatatttgggataattatcgattgtaatctgaaagcgggttacaaatacttcatatataatcctgaagtgttaagagaaggcgaactaaacaaatggttgctcgattcattctccactatcaataccctatcacaaagtattacactaaaaaatagaattctcgtagaagaaatcccctcaagtaaagatttcttaaaagacataatcggggccatgcgagataataagataatagagctgacttacaaaggcttccagcggcatcatgcctgcacctttcctatcgagccttattgtttgaagatgttccagaaacgatggtatatattgacccatagtatcaatgatgatgaaatacgactgtacgctatggacagaatagagagcgccagtgtgaccgatacatgcttcactttgccaaaggactttgatgctaaatcctatttcgcttctttctttggaattgtgcttgataaggatattaaggaagaaaaaatcgtgttacgtgctgacagatatcatcaacattatcttcgcacacttccacttcacccttcacaacgggaaatatacacttctgatgaatatgcagatttcgaattgcatcttcgaccgacatacgacttctgtatggagttactaaaagttggcgcaatgattgaagtattagaaccccaatcacttcgtcatcaacttcatggctgtattaaggatatgtggaaaatatatgaaaacgattaatgaaagtcatttaagtgttgatagttagtaccaaagattgcattttaattcttataaaataaataataatgaaagtatacactcacttctatctaatggatgagaacactgctataggttttcgatggaggacattgttacaatatggtaattcatgggaggttatcggatcagtggtaatgaaaaatccaggtggtgccaaatttaaatcccccacccaccaagcaattgacgatgccgaaacgttaagacaactccggcactttgacgaaagtaaagacaagtggtatgaatttggtagtgataccacaattgactgtgtaggcgatctctttgctttctactatgatctgccaagccgtgaagatttgaacggtgtgatacaaatttttaatctcttctatatcaaagaagcagatttaagtaaggctttggtatattcagaagcaaccagcaatacatttcgttttgcagatgaagaaaatgtgaccaattacgacatagagcaccttgttcctccagtctaccttggctttggaaatttggcttggcataaaagatataaccaaaaggctgaacagtttttcaatgccgctattaataagtgtggaatgaaatatcttgaccctatattccaacacaataattttacgcatccactttatctcatgcgttatgcaaagaataaacccaagtatataaggtatcggatgaagttcaaacagaatacgttgataccaacaggcgtggaaaatgctatctctgatgcaagatcaaccttaagcaaacatatacctaatatggaaagagctaaaaggcaagagcagagacaaaagatcgcagatgaagttttcaaccatttgaaaaatcaaaaagggtatcaggtggtagcaataaaaggtaagaacggtatttcactgtgtaatggtgctgtacggcttgttattaatagtaacaaaaatgaagccgtacatctatttgttaactgtgggaccaaaggcatgagtaaagaaagcatgaaatcttttttcaacaaaatggaaaattcgtttggattccagcgagcatatgatatacaaaaatacgaaaatagaatgcatctttcatttgcaaaattgacaagccaaaatccacttgagaagatagaacaaatagtatcatttgtagaaacatcgttatctaatgaaaaataaatatctttttctcgattttgacggtatactcaattctaataaaaattatcgaacattgcagatgttgggtatacctacacgagatgaatatggtactatctttgatccccaatatgtagaatgtttgcgtgacattatagatatatttgctggaacctgttatttgcaaaaatgttcggtcaactcaataatcgtgaaagtctccgttacttgattttagctttggaaacacatcaaagaaagcgttatcattttggggttggggcgtgaactcatagccaaaactacgcttgtatctgccaatcaaaatcgagattaatcatgagccgaatgcatacatatagagcgtatgactcatgcaaggaactttattggattaatcttacaggatctttccttgtcgttagaacgaagtcagacctgaagtgcaagtctgtaaatgaaaacgtagaatgtcggaaaatatcccttctaatgtcataaatagatatttctctaaagaaactgacatttctaatgacataagaagagcattattaacaataggggttaatggaaaatatgagtactatgaatattggtggtctttttggtacgttagcaatgcaaataagagatgtttaattgataaatttagggagcttgaatattatatttatagcgattgtaaactatacttcaaagaattggtattaaaactaatagataattctctaagagatattattgaaaattttgttccaccccataatatgccaaattggaaaatacaactgataaaagacccagcgttacttgataaaaacacttctcattatatagcaattcctgaagataactcatactgctacttattaaaaagtaaacgtccaagggatattgatgggagtattaaaataaaataacagaataggcaaaccaggattatctaaaaagacaatcctggttaaatttagtagttcgaaaataggagagcagactcatttggatcaatatacttaaacgattggggagcagcaaaagccttaaataattcgaatggattaattggttcttcataaagacgtggagaactgattttcaaggcatacccatgtgtacgaccttcaaagtattggtcaaaaaaatccttagtgatacctgaatccttatgagtctggtcccatagtgtactaggggtatcatttagaatattctctactgtaaattccccaacaatcatcccaacaggctttgttgaatagaccactactttatctacactccttgtgaaaataacttttctatattcatattttttctttcctgtaaaaatttcctgtacaaattcaggtttaatcgataataagactttcatttatttttcctcttgatattatattcttaaattgttcatcatttatttgcataaatccccaatagtcaccagccgaaaggccgacctgttcaataagttcaccacgggtaactcttctatcaaatgcaatattataagtcatttttataagagtcatcccatattctgtataccatttccgtagctcattttcattaaatatactataagcgtttgcatatttgataaattcctctgtagatttaaaatcagaagccttttttatttcttctacaatacagatagaagacacaacactacgataatatgcagcccctttttcgtctttcattcgatagattaaaagaatatctcctcttgacaattgatcaatattcctcattttacacaaataaatcttatgtatgctatttgtgtaagcaatgtctcgcacaagaaaagatttatcacgttcctcattatctaaaattgaatcaggaaagagcggagtatgatattcaggttttattgatagaataaactttcgtacttttgaagtatgaatataaggataatcatacaacaaatctcctgaatatactttcatagactttacaaatacaaactccggttcatcctcatgacctttagttccatatacaaggaatccatatctctttaacaaccttataagcccttcatgtttcctgtatatcgtcacatatatttcatccgcatcaatatgaagagcagctaccactattttttttacaaattgttctcccaacttagtattatgagcttctattttaaaagttccaacttttagtctattagctgcaggcattggcggacatacatctgttatatcttctaattcctgttttaaatatagaaaagcttgcaacatcccttcattattcttttgaataaaagcctttgcattatctttctttttcttattataccacttagaaaattcgggataatcttcctttaaagaattaaaaaagggatcagataaactgatattgcaaaaactttgttgctccatagcttttctttattacttatacgtttgttctattattcttgttatgcgatacaaattaacgaaaaaacttctagaagtaaaaggagaagataataaatcttctaaatgaataacatccaaaatctagaatacctttaaaatatttgataaaaaagactttatctgttttagaggtgatagtgaagcaagatgatagaaaatgaacatagtacatattttagtttatatcatttaaactgaaaatatgtactatatattcttttaccctataatacttttaatgtaatccgtaggacatacatgatagaagtctttgaacttctttccaaaatatttagcatcacaatatcccagcattcctgcaatttccgaaacagtgtactgttgggaggctagcagtttaagtgccctgtccattttgaacgaatagatataattttccggaggattcccggttatctctcgtatcctgctataaaaagcagtacggctcattcctatatcaatacttaatttatctattgtatatttatcagtagagaggttcttttccaggattttattgactttatccataaatatctgatccgtattttctgtttccatttcttctttggtggggaccattggaaaaacagcatctgacaaaaacaatttgacccgttcacgcaaaaccatgcggttttctacaagcatacgtatgtttgcccttagcctgcaaatgctttctgttcgtaattccagacgatccgccccacttcctaaatgggacaaataactttcgttatcaaaggcccttatcaaaaggacaaccggtatataccctatcattttatctgttttgatccggaaactaagtgcatctccatttgttccgtttacattatcgtcaataatgatagcatcaggattttggcggactactgtatccttcagcaaatcaggatctttcaaaactgaaatctgaaaataccgcgataaagctttccttaaataattcctgaatgccccgtccgccattaccaataagatatgggatgtatcttttgttttagcattcggggtatcatctttatcactttcagaagattttttagccttattcttcgtatttgttgaagaatgtttgataaccgaacattcctgattccggcaatgacaatctgttggaatgacaatttggaaagcaaatgatttgccatgtctatatccgtttatttttccaccatgcaggcgaatgatttttcttacagtccacaaatcactatacccatatataggaaatatgaccggaataaaaggaaacattttccctactcttttgtctgctatctcacaattagtaatctgcaactgccaggaatctgttgtatgtgttatattgattgatatgcaacaacctaaatcggaacccaaaattagtttgcttataagatgctgaagcgctgccgtcataatgttttcattgattctgcaactgacgcaatccgaacattcgctgacagtcagttgtatacggcgcgaatcagcataaggtcgacattgattgacaatagaagtaatataagaagagagttccaaatttgccgttgatgtcttaggaagtatttttttgtttaccttattgagggttacaatattctgattgcaatatatgatgtattcggtatatcccaatgcctcttctacttgttgggaaagcgattcgggaagattaccggttttaagttcttccaattgatttcgtaacaatatcaacggggtatacgtagtatggagcatgttcatagctatcttaagtttttcatgtgacaacaactgaacattatactctaccgcaagatacgcaaacaaaacaataaatagcccaatgccgaaactctctacaggaactgcataaccaagcaatgacaaatcaggcaaaattacgccaatagcttgtttactgtttactaaattggctccactatctatagaaagtaaagcgcgaaagtttaataataaactcaggtaacaatcattcatacttatataggatttgattaatacttacattttcagcaaaacacgtttgatgaccttttaacgtgtctaaatccggcacaagtataaacttttcaacatccacatatgaggtggattctaacaaaaacaatgggtattttctatcaaaagtggtaacaatatcgtttgttaccgaaatctcaagggatagattctaaaatcatcatttcatttggtaaaacatagtaattgtaaaatattttatcacaaaacaatacaaccacacgaacatatagttccacttaatcattaaaataatgaaataagtagaattatcaagccgcgtatataatttgaaaataatagacttctgataagtactgtcagatcatagtttacaggaatacctcatcataagacggaataatctttgcatcgtaaacgtgagtggccgcaaatacatcgtctttctttatcaacaaccagtctttatcctgatcatccatattggtatgtataaggacaaatagccctttgagtttatgcccgtgtaacttgaattcaagtattccatttttaatagcagcggaaatgttacgattattaccaacgtaagcataggttccactatcccatatttccaccgtacctgctccatagttaccttccggtataactccttcaaagtgcgcataactcaaggggtggtcttctacttctatggccaacctcttatcttttggattcatggaaggtcctttaggcaccacccaactttttaatactccatccacttccaaacgaaaatcgaaatgaaaatgactggcatcatgcttctgaacaacaaaaacaggcattcgattgggagtttccaccgtatccgccatcggttccggtgttttaccgaattgcctttttgcccggtactctttgaggttaatcatagaggcttcaaccgcctgcttttctaccattttgatgttttttccttcatcgggagaattctttgccataatctgtattttttaggtgaataaaaaaacgaatgattcaatgtgacaacaatcagtatatctgtttgtttgtcgaaattcatctattttaatggctttagaactgcatttaagtttgctaacttatttttagtcttctccctttcttactgcctgcatagtgggtacaaaaatccctttcaatcgtccttttataaaagtataaaagcaattggaaggaaatgaataaaaagagattaatcggatatctgttcgtcacgatgtctgttggttgtattcaggcgcaggaacagaagtcttctgtacccgaatacaagctatggtacgactgtcccgcacaggtatggaccgaggcattaccccttgggaatggtcgtttgggggccatggtatatggaacaccaggcacagaacaaatacaactaaacgaagaaagcatttgggcgggacgtcccaataataacgccaatccggatgcactggaatatattccgaaagtgcgtgagctggtctttgccggaaaatatcttgaagcacagacactggccacagagaaggtgatggcaaagactaattcaggaatgccataccaaagttttggtgacctgcgaatcgcttttccaggtcatacacgttattccaattattacagggaattaagtctggattccgcacgtgcaatcgtacgttatgaagtagacggagtgcagtatcaacgcgaaacgattacttcatttaccgatcaggtagtaatggtacgactgaccgccaatcgtcccggacaaattactttcaatgcacaactcacttcccctcaccaggatgttatgatcgcttctgaagagggaaactgtgtgacactctcgggagtctcttccttgcatgaaggattgaaaggaaaagtagaatttcaaggcagattgactgctaaaaataaaggtgggaaaatagcttgtgccgatggaatactttctgttgagaaagccgacgaagcggttatctatgtatccattgcaactaatttcaacaactatcaagacatcaccggtaatcagacagagcgggcaaagaattatttggcgaaagcaatggttcatccgttcattgaatcgaagaagaatcatgttgatttttaccgacaatatctgacacgcgtttctcttgatttgggacgagaccaatatgcgaatgtaaccaccgataagcgtgtggagaatttcaaaaacaccaatgacacacatctggttgccacctattttcaattcggacgttatttgttgatctgttcttcccaaccgggaggacaacccgccaatttacaaggaatttggaatgacaaattattcccttcctgggatagcaaatatacttgtaacatcaatttggaaatgaattactggccttcggaagtaacgaatctaagtgaactgaatgaaccgttattccgtctgataaaagaagtgagtgacacaggtaaagagacggctaagattatgtatggagccaacggatgggtgttgcatcataacacggatatatggcgtattacaggagcagttgacaaagctccttcgggtatgtggcccagtggtggcgcatggctttgccgacatctttgggagcgttatctatacaccggagatgtggaattcctgcgttctgtctatccgatactgaaagagtccggacgtttctttgatgaaattatggtgaaagaacccgtacacaactggctggtagtctgccccagtaattcaccggagaatgtacattcgggaagtaacgggaaagctactacagctgccggatgcaccatggacaaccaattgattttcgatctttggacagcaattatatctgcttctcaaatactggatacagatcaggagtttgcctctcatctgacacaacgtctcaaagaaatggctcccatgcaggtgggacattgggggcaattacaagagtggatgttcgactgggatgatccgaaggacgtacaccgtcacatttctcatttgtacggactcttccccagcaatcagatttccccttaccgtactcctgaactatttgatgcagcacgtacttctctgattcatcgtggcgacccgtcgaccgggtggagcatgggatggaaagtttgcctttgggcacgcctgcttgatggcgaccacgcctacaagctgataactgaccagctgactctcgtacgcaatgaaaagaaaaaaggaggcacctaccctaacctgttcgatgcgcacccaccatttcagattgatggaaactttggttgtgccgcgggtattgcagagatgttgatgcaaagttacgatggttttatatatttgcttcctgcgctgcctaccgtttggacagaaggttctatcaaaggaattattgcccgtggaggtttcgaacttgatttgagttggaaaaacgggagagtcagccggctggttgtcaaatctcataagggaggaaattgtcgtctacgttcgctcaatccattaaccgggaatggcttgaagcgtgccaaaggtgaaaatccgaaccctctttatgcagtccccaccattccggagccattgattaacgaaaaggccaacttgaacaaagtggaaattgcagagacatacctctatgacctacctaccaaagcaggaaaagaatatgtattgattggaaaataataactcgaccgatatgaacaaaaacttattgaaactgattgtcgcctgtggaactgcttgtttcctagcttgcgcagcacctcaaaaaacagaaacggaaaaatggagtgaacgcatggcacgctccgaaatgaaacgtttccccgaaccctggatgattgaaaaagctaaaaaaccacgctggggatatacccacggattagtagtgaaatccatgttggaagaatggaaacataccggggacagcgtatattatgagtatgccaagatatatgcagatagtctgatcgatgctgacggacatatcaaaaccatgaaatatctttcattcaatattgataatgtcaacggtggaaagattcttttcgatctttacgcacagactggagacgaacgctacaaaatagccatggatactttgcgtaagcaaatggcagagcaaccccgtaccagtgagggaggattctggcataaattgagatatcctcatcaaatgtggctggacggaatttttatggcttctccttatctggttcaatatggtgctacttttaatgagcccgctttatttgacgaagcaacaaaacagattcttttgataaatagcaagacttatgatcctgcaacagggcttttttatcacggatgggatgaaagtcgcgaacagaaatggtcaaatcctgaaacaggttgctctcctaatttttggagtcgcagtatcggatggtatggagctgctattgtagatgtactggacttcctgccacaggaaacagccggacgcgacagcattatacaaattctgcagggattggcaaaagcgattgtgaaataccaagatccttcatccggaacctggtatcaggtaaccgatcagggagcacgtgaaggtaattatttggaatcatctgccactgccctgtttatctatacgcttgccaaagctatcaataaaggatatattggcaacgaatatatcgaaccgacacaaaaagcctttgacggaatggtaaagacatttacccgtttggaagaggatggcagctatacaattaccaattgctgtgctgttgcaggattgggcggagattcaaaaagatatcgtgacggctcatttgagtattatatcagtgaaccgattatagaaaatgatccgaaatcggtaggttcattcatcttggctgctattgagtatgagaaaatgactaaaaaataaactaaaaacgataaaatacaatgagaaaattcaagattattccccttttgttgctgctattgacaatggcaacttcggctgcagcacagaagaaaacacaaaagacgtatatcccctgggacaacggcaaactcatagtttccgaagagggacgttacctgaaacacgaaaacggtgctcctttcttttggttaggagaaaccggttggctattgcccgaacgcttgaaccgggatgaagccgaatattacctggaacaatgcaaacgtcgcggatacaacgtgattcaggttcaaacgttgaacaatgttccgtctatgaatatctacggacaatattcgatgattgacggatacaacttcaaaaacatcaatcaaaaaggcgtatacggttattgggatcacatggattacatcatccgtacagcagcaaagaagggacaatatatcggcatggtctgcatttggggaagcccggtgaaccggggcgagatgactgtagaacaggcaaaagcatacggcaagtttttggcagagcgttataaggacgaaccgaatattatctggtttattggtggagatatccgtggcgacgtgaaaactgctgaatgggaagctttggcaacctctatcaaagctatcgacaaaaatcacctgatgacattccatccacgtggaagaacaacttccgcaacttggttcaataatgctccttggttggatttcaacatgtttcaaagcggacatcgtcgctatggacaacgtttcggagatggtgactaccctatcgaagaaaatacggaagaggataactggcgttttgtagaacgcagcctggccatgaaacccatgaagcctgtgattgacggtgaaccgatctatgaagaaatacctcatggtctgcacgatgaaaacgaactgttgtggaaggattatgacgtacgtcgttatgcttattggtctgtatttgcaggttctttcggacatacttacggtcataattccatcatgcaatttatcaaaccgggtgtaggtggtgcttatggtgcaaagaagccttggtatgatgctttgaatgatccgggctacaatcagatgaagtatctgaaaaacctgatgttgactttcccgttctttgaacgcatacccgatcagtctatcatcacaggacagaatggagaacgttatgaccgcgctatcgctacacgtggaaatgattatctgatggtatacaactataccggacgtccgatggaagttgatttcagcaagattagcggcgcaaaaaagaatgcctggtggtacaccacgaaagatggtaaactggaatacatcggagaatttgataacggagtgcacaaattccagcacgacagtggttattgcagtggaaacgatcatattctgattgtagtggatagtagtaagaactatgtggagaaggcctggacagaattaccaaatgcacaacaaaaatgggctaaataattttgtattattaggcacagattacacggattttacggttttcagaatgacagataggtaaaacaacagcgttaatccgtgcaatccgtgcctaattttattatataaacgaattatgaaaacatacttatgaataaaagaatagtatcatttttctttcttctgctctttgcaggttcactatacgcagccataggtatcactgacctgcgaacggagcagttgaaaaatccggcaggtatcgatgtgcgccaaccccgattgagctggcgcatcgaatcggatgaacagaatgtgatacaaactgcgtatcacattcttgtcgcatcttccccggagctattggaacaaggaaaaggagatatttgggattcaggaaagattgaatctgacgcttcccaatggatcacttatcagggaaaaacattaaaatgtaatgctccctactattggaaagtgaaaatagacaccaacaaaggtgcaacgaattggagtgttccggctttctggatcaccggactatttaatgaagcggactggcaaggacaatggatcggcttggacagggccgctcccggagacagcgaaacacgatggagccgtttggcagcccgttatctccgtaaagagtttgcagtaaagaaaagtgtgaaacgtgccacagtacatatcgccggaatgggattgtacgagttgtttatcaacggacaacgcatcggcaatcaagtactggcacctgctcctaccgactaccggaaaacaattctgtacaacacatacgatgttacttcactgcttcaaacagaaaatgctattggagtaactctcggaaatggtcgcttctatacgatgcgtcagaactataaaccgtataagataccgactttcggttatcctaaactccggttgaatctgattgtggaatatgcagacggcagcaaagaaacgattgctacaaacacttcatggaaattgactactgaaggtcctatccgtagcaataatgaatatgatggcgaagaatatgatgcccgtaaagagctaggagcctggactcaaaccggatatgatgacaaaaactggatgccggcccaacgtgtcagtattccttcaggaacattgcgcgcacaaatgatgccgggcatgaaagttacagaaaccctgaagcccgtttctattaaaaagcttggtaacaaatatatcctggatatcggtcagaatatggcgggctgggtacgtttccggataaaaggacaggctggcgatagcatccgtctccgttttgcagaaagtctgcaagacaatggcgaactttatacaagaaacttcagggatgcccgttctacagatgtatatgttgtcagcggacgcgaaacaaaagatgctacctgggcacctcgttttatttatcatggattccgttatgtagaagtcagcggttatccgaatgcgaaggcagaagatttcgttgccgaagtagtagaagatgaaatggagcatatcggtactttcaactgttctgacgaaactctgaataagattatccgtaatgcattttggggaatccggagcaactataaagggatgccggttgactgtccgcaacggaatgaacgccaaccatggttgggtgaccgtaccatgggctgttggggagaaagcatgcttttcgataattacgccatgtataccaaatggacgcgtgacatccgtgaagcacaacgggaagacggctgtattcctgatgtagccccagcatactggaactactactcggacaatgtgacttggcctgccgctttaccaatggcctgcgacatgcttttcacaaactttggagataaacgtccgatcgaagagaattatccggctatcaagaagtgggtatctcatatccgtgaatactacatgacagaggatcttatcatcaccaaagataaatatggtgactggtgcgttccacccgaatcactggagttaattcatagcaaggacccttcccgcaagactgacggagctctgatcgcaaccgcttattatctgaaagtattacaactgatgcaccgctttgcaagcctgcaagggctgaaagctgacgcagaagaatgggaagatttggaacatcgcatgaaagacgcattcaatgcccgttttcttcacgtaaaggaaggtacctctcccgtaccgggacataccttatatccggatagtattttctatggtaacaacacagttactgccaatatcttgccacttgcttttggtctagtgccaaagaactatatcaatgaagtagctaaaaatgccgtaacttccattattacaaccaacaagggacatataagtaccggagtgatcggcgtacaatggttattgcgtgaattgagccgtcgcggccatgccaatgtagcttatctactggctaccaataaaacatatccttcctggggatatatggttgaaaaaggtgctaccactatttgggagttatggaacggtgatacggcaaatcctgaaatgaatagcggtaatcacgtgatgcttttaggtgatttattaccgtggtgcttcaataacttggcaggtatccgtgcggaccgctggaagtccggttacaagcatatcgtcttccagccggcttttgaaattcaggagttgagtaacgtggatgcatcgtacataagtatctacggaaaaataaccagccgatggacaaagactcccacacatttggaatgggatatcgaacttcccgccaatacgacgggggaagtacatcttccggatggacggaaagaaaaaatcggatcaggaaaatatcatttcagtgtagacattcccacccggaatacggctattctgactgatgaatttctgtacgaaaacgcttctttccccgaatgtcacggagctacgatagtagagctgaaaaatggtgatctcgtagcctctttcttcggaggaaccaaagagcgcaatccggattgttgcatctgggtatgtcgtaaacctaaaggctctaaagaatggaccgcccccaaacttgctgccgacggtgtgttttcactcaaagactcacaagcagtattagctggaatcgattcaacctgtaccccggtgaaagatgcaaaaggaacacttattgcccgcagaaaagcttgctggaacccagttcttttccagattcccggaggtgacctgattctgttttataaaataggtttgaaagtgagcgactggacaggatggcttgtccgttcacgcgacggaggaaaaacctggagcaaacgcgaagcgcttccgaaaggttttcttggacctattaagaataaaccggaatatatcaatgggcgtatcatctgcccttccagtacggaaggaagtaacggatggcgtgtccatttcgagatttccgatgataaaggcaagacctggaagatggtcggaccactggatgccgagttatctgtccccacccaaaatcgtaaaaagggaggtgtgaatgtggatgaccaggaaggcggagaagcgatcgaaggagaaggagccaaacctgtttatgcaatacaacccagtattttgaagcataaggatggaagattacagatactctgtcgtacacgtaacgcacaggtagcaactgcgtggagcagtgataatggtgacacatggagtaaagttacgttgctggatgtcccgaataataattccggtacggatgccgtgacaatgaaagacggtagacatatccttatctacaataatttctctacattgcccggaactccgaaaggtccgcgtactccgctctgtgtggccgtttcagaagatggtatcaattggcagcctgttcttacattagaagatagtccgatcagccaatactcttaccctagcattattcaggggaaagacgggaagctgcatgccatttatacatggcgccgtcaacgaattaaatatgcagagatagatccgacgaagttttaaatattgaacgatcatctgaatgaaatcgaccgctcctttgcccgcaaaagagcggtcgattcttgtatttatccattttatactttacatttgccaataaataaaaaataacgatggcagataattacatagaaagacaacaggaacaatacgaagcccgaaaagctgcttggaaacaagcacaaaaatatggtaagaagaaactaacagcagtacgtccggctgaatcgaagtctcacacttcaacggtttcaaaaccggaggattcaaaaagaagagtatttataacaggcggagcggaaggaataggcaaagcaatagtagaagctttttgcctagctggaaatcaagttgccttttgtgatataaacgaaacatcgggacaggagactgcgaaggcaaccggggctatgttccataaggtcgacgtaagtgataaaaacgcacttgaaagttgtatgcaaaccattcttgccgaatggaacgatattgatattattgtcaacaacgtcggtatcagcaaattttcttctatcacagaaacaagtgtagaggatttcgacaaaattctttctattaacctgcgtcctgtattcatcacttcccggctgcttgccatccatcgtaaaaagcagccctctcccaacccatacggccgaattataaatatctgctctacacgttatctgatgagtgaaccgggaagtgaagggtatgcagcatcgaaaggtggtatctattctttgactcatgcattggctttgtctttatccgaatggaatatcaccgtaaattccattgctccgggatggatacagactcatgattatgatcaactccaaccggaagaccattcacagcatccttcacgccgggtaggcaaaccggaagatattgcccgcatgtgtctgtttctctgcgaggaaaacaatgatttcatcaatggagaaaacatcactattgacgggggaatgacgaaaaagatgatttatattgaataaaaatctatcactttaatgaatactatcgtatttgttaaggtcttttgggcacgataacaaatacgatagtatccactatttattgcattaatattcttcgagcaacttccactccagttttcactatcgaagcagcatgatggaactccaacatatcatacgtatcgccggaaatttgaattaagatatccggctgacaacgttctatctgataacgggtgatttgctgcatcatcatcctggaagattctgtcaacagattataaggagatactttctttttctttccggtatcaatgggtgcattcacatcgacagctatcagaatgtctccttcagtgcgttgcacatgactcaatggaagaggattcagaatacctccatcaatcaataccataccgtcttttcttaatgggcggaaaagcatagggatagaaatagacgcacggatagcttcatgtaagctccctctgtcaaacctgacttcctgatcgcggacaatatccgtagccatcgctacataagggacaggcaggtcttcaatattcatgtccggaataatttgtttcagttctttaataaaacggtcacctttcactaatccatcccggcttaaggtaagatccgccaattcccacatcttgcgtttgtcccaactatacagccattctttacattcttccatttttcctgaagcatacattgctcccaccattgctcccatggaacttcctgcaatggaagtaatctcaaagttgtgacgaagtaattcttcaattactcctatatgtgctattccacgtgctccacccatggaaaggactaatgctactttttgcttatccatatcatatacatttctgttagccatctacaaaataacacattttctgcgaaaaagatgtttagtaatcgtgaagaaataaattatagcagtgttttaggggaactaaagcatagctttagatatgataaagctatactttgtcagttgcaaagcatagctctattatattcttctattatcccggagattttccggttatgtaggaggttaagggtttaccctcatttatttctttccttgagccttcttttctgcgtttcgcttattcacgtaatctttgaacatctgccgccagttgcgaccatgctcattgaaatactgttcgcatttggttttataaatttcgaagatagcagaaatctgcttcatattcttgtagtcaatagcctgttcgcgagccagtttcaactgttccagaacaaaagtcgtttcctcctccgtcatattgggcacgatggcctgataacctttcaaggtaaaagcaactttacctaccgtgtatttatccaggatttgttcaatctgttcttccgtcaatactctgtgtaaatctttcattagcctttcatgcacttctttcggcatagcagaatctgcaatcatttcacggtcgagcttggaaagcggtttgcctgtcagaggattgataccctcggggattgttgtataagggtgctcattgtgccagtcacgcactttacgaagatgattataaatggcagttactgcaaaacctgcttttttatcatcgttcaactctaaagaagctacccagtcgatggctttcttttcgagagaagcatctgattttaaattagcaaaagccttcttgtcaaaataagcagctaccttgtcaaaagaacggatggcgccttcaggaagcaaagctcctttttcaccaaaactatacatagcggattccggttcaatggtgaccttgctttcatccaacatctttttatccaatttgaatacttctgcgaagaagtcataaacagcattccgcttattcgggccaaagtcatgtttctctttgggaagatgtacattcgttactttatcttttgcctggtagaatccgtaaattcgttgcagataaggaaattcaagagtaggaacactggccgtccagtcgccgccatccgatacgatcagttgtggacgaggagcaaaagtagcggctaattccgcattacaggttcctcctgcagatagttgaataggcattccgctttcgcagggacaaccaccgtcgaagtgagaagccaggctcaccaccggagctgaagcggtgaaacgatcatctaatacgctcaacaatacagtatgggtacctccacccgaaccgccattcgtaccgatacggctggtatcaatgtccttacgggaagcaagcatgtagtcaagaatcagtaagccgttcattgcctgaatagtgtgcgccgcactactacggtgtgccgcactgcccacttgcaaagccgactctccccatccgaacaaatcatagtctacacaaacagctcccatacgtgctaaagttcccatacgttgttgttggtcttcccgataacgtccgccaccaaaatgtccgttagggcagattatcaacgcatgttttcctttcgattggggcgtatagatagaaccgcaaacgtataacccgggaagtgtttcaagcgcgaaattctgcacggtatagccatcaaacttacgtatctttgaaagaataggtttggatttgacacattgagccaacaaaggatcgatacctaaacgctgacgtacctcttttttcagagaatcggcacgaagttgaaaggactgttggtctgtatagagtgtattcagataagccagcatcttctctccgtctgcatctgtacgacgtggatactcgtatgctttcagcttatacatatttcctttctgcttaacaaatttataatcgaaaggtgccaatacattcgtcaaggattcttccacggaataaggacgaatacggaaatcggcataaggcagcacttttcccaccgtatcaatgtcatatttcaaacggactccgaaacggttctgtatatccgtcagtacttcattcaagggacgggcaaattctgtctcgtatgtttgcgtctgggcttcggccgaaagagatgcggcaagaagcatagtaaaaaggattcgtttcatttatttttaatttatgtaagttgttttttcaccacagattacacagattttcacagatttattattcttataatttagtcgaattaaaaatctgtgttaatctgtagtatctgttgtgtgcttttaattacttcaccattgacgattacgtcatccatcgtgatacgttcacaattttcgaagatacatttctgtttccctccctgaatatgaatatcacgcaaaacaatgtcagatatcggcgcttcttccaagcccactattttgatcggagtctttacgtttgtcacagtcattccgctgatatgtacgttacggaatatcggagtgcgttcactcttaggttcggcaggcattttactgtatttcaaattcaatacgacagcttcctgtttaatgttgctcattacgacgttgctgacacgaatatcttcaacgactcctccccttccacgggttgacttaatacgaattccacgatctgttccgtcaaacacgcaattggaaatagtaactttacgcacactcccactcatctcgctgccgataacaacacctccatgaccggaaagcatggtacagttggtgatagtgatattctcgcaaggtactcccaaacgacgggcctgcgcatctcttcccgacttgattgtgatgcaatcgtctcctactgatatatggcagtcgctgatatgtacgttgcggcaggattccggattcactccgtccgtatttggtgagggcgcattatctatggtgatcccctttatggttacattgtcgcaaaactccggattgaccgtccagaagggagaatttatgattttcactccttcaatctttactttcttacaacgaacgggctgaatgaacggaggacggaaaaagcgacgttgcaatgtatttacataatccttgttcgtttcagcataaattgctgtcgtatcatttgctgcatcccacattggctgatatttattcacatcacgcatgccattgtctttcaaatcaatcatgacacgaaagaactccatccaccatttctttccttgtccgtccaaagttccttctcctttgatcgtaatattctcggcatctaccgcataaatcaaaggctggaaacttttcatcatcactccttcatgacgaacctcgacaaaaggaagatagtcatcaaagttatcggaaaagagcaaggtagctccggcttccaactccagtgtaatattacttttcagatggatactccccgtcaggtaagttccggcaggaaagaaaagagtacctccgccaccacggttcagacggtcaatcgttgaattgattagctttgtattaagagtcttgccatttgcttttgcaccggccttcagcatatctacacgctcggcacgaagaactgtggttgcacagaagcaaagaaagacaaaaagagttgttcgtaaattcataatcgatattattaaagtatatttcatcgtttccttctaaaaaatcatgctaatagaatctttttttcttcccaatgtttgaagacaatcattgagatgtttttttcaaacatgctacatgattaaaataaagatgctgcatgattttttatacgaatacattgttttttaattctacaaatatatacaaaaaggttcttttattttgcacaaaccaattgatatgttccgctctgtatttctttcggttcttttccgcccgggagataaacaacagcggtagtattcaccggaacagacacgtttaaagtgaaagtcccattctcacaagtccagtccacattaatggtaccgtataaagtttcatacgacgctttgacatatttcaaatctcccacaggttggggagcgatgatgaacttctgataaccttgttttggagtggtagaaggacgaataccgaccagtgaattaaagaaccattcatcaatctgtcccatcataaagtgattccaggaagaaccttgacgggggtcccattgctcggtcaaagttgtagcgccgaattttaactggaaaccatatccgggagcttcttcatgattgaacattttataaataagttcatgttctccattacgcgccaatgtctgaatcagataacggtttcccacatcaccggtagtcaaacggttgccatgtgcttccacatcttttatcagattcgcgaatactttctcattcaaatctgcatccggtcggtagttatcttgttcatctgcatcctgcgtcatttggaggaacaacggaagcgcattactgcattggcttcctgtaccatattgtgccgtatctttatgaagaaaacatttattaaatgcaaccattatctcctgtgccaacgaagtgtaataacgaatgtcaaagtcattacccaccattttcgcggcttgtaccaaatacatgactgtcatgtaataatgcgcagtagccaccaaaggaacgggtgtattccgtgagaatcccgcacgaaaatctccgtaatcataccagtctcccaatccgaaagaaagaatacctgtatctgcacgagtcttgagataatccacgtaacgacgcatattcggataatatttcttaatcaatgaatcgtctccataagtctcatagtacataaaagggaaaataaccaaagacccaccccactccggagattcggcaaaagcatccatacccggaccttcaaaaatcacgtattccggagcagttgtcggcatggctccgttggaatgttgtgcatctgccatattctgcataatctgcggagcgtatgctgtcaaatcatagttatacaacaaacccggaccattcagatgtacctgttccagccacccaagtttctcacgatgcggacaatccgtaaacacagactgcatattgctgcgaaccgctttctcgatcaatcgatgggcagcattaaatatccggttggatgattcgaaagtggaaactttcttggctgaattatatacgaaacaggattgaatattctttaatacaggcaatttctgcggattcttctgtccttttaagacagcaccctctacctgaatatatctaaaaccgtaataagagaaacgagggtgccagatttcatcgccttcccctttcagaatgtattcgtaatagtgttgacgccctgtctgacgctgattgcaagcaccttcctctgtcaatgcttcggctacaatcaaagttactttctgaccacgtttgccacgtacttttatttccggaaagccagccaaattctgtcccatatccaacacaaaagcagaaggatcgactgttctcttagttgatacagaagctgatgcaacttggtccgcatttagtttggttaccttttgaatatcataccgttccatgattttcactggagccgccatctgtggacgaagtattcctttaggagcttcctgtatgactaccggacgccaatgactgtcatcaaagccaatctgattccatcctttctgttcacgacgcgcatcataatcttctcctccatatatgcaattgaaggttaccggactaaaatcatatttccaattattatcggaatgaaccgtcgtacatgttccatcttcgtagttaataaccagctcaaataaaagtgtgggaggaccaaagctgatctgtaatttgcgataacgccccccctgcacattatagaatccattccccaataagattcctacgacattttcaccacgccgcaattgttccgtcacatcgtatgtgttatagtaaacagttttatcataatcactccacaatggggcaaactcactgttacccatctttttgccattcaaagaaaactcatagaatcccagaccacaaacgtatgccgttgcctccactattttcttgcccggtttacggtttgcacccccttctttcgcatctcctacctggaatgttcttctcaaacaaatacttttctttgccaaagtgtccactgcttcccaagcagctttcacttccggtttcttcagctctccaccgtggaacttacgcccttccggtaaatgagcattttgtcgggtaatagctccaatccactgccccgaagataacctttcgggtactgcccggaatttcgcttcattgctccactcggaaggtgtatctgtttcatcccaaacacgaacgcgccaactataattaaatgagttatcaggacgtatatctgccccctttgtagaaactaactggctctgcgaagaataaaccttcccactattccaaacggaacgccctgtaaaagcttcccgaatatcaatctcataggcagattgtcgtgtcccattttccggcgattccatcacccagcccaaacggggtgaaccttcgaccactaccagtccctcctgcatctcacaggtaagacgactgatggttatattcttcgcctgtacaaaacaagacaaacaaattagcaatgaaagaagaatctttttgaatttcatttttcaagtatcttttatttgttcgataaatgagaatttatcggttaaatgggaattttgcagttaggctgaaagccttacaattatatatttattggggtgccctgaaagggcttaattatatagcgtagggcaacgccctacgaaaaaaacacaccagccacaagccctgaaagggcggaaccatatacaattatgccctttcagggcgcaaattcagattgtcgcttttacgtagggcgttgccctacgctatataattaaaccctttcagggcactccgcaaaattatcatttaagtgcattttcacaaacgatttttgtcaatgtattcgcctgccctacttccttaccatctacaaaaatgcgcaatccttttccgcaatgatagcgatcaccattcttatcccaaagaatcgtcagattatgaccatgatataatacattatccaggcagaaccaatcccacttgtcggcaggaattaaggggttcacttcaatcgtattatccaaacgtggacgaagtccgatcaatcctgtaattatcaggtcgttgaaagtggaatggttataataacggctacgttcctgatctcctttcagccaataaccggtcacctcatccaaatattcaccaatatagggacgaccacgatgatactgtgattccacatacaattccatctgacggaaatatacactgtcagacaatacagtctgcggataattattcataaagttagccattgctgtcaatgtctgtgcggaagcaaacggccagatagcaccgtcccattcacatttgcctactccacgtgtacggaactccggatgacgacgttctgcagttgtcaatccataaggagcagagaagcctttttcatccataatttctttccaggcaatttcatacttttgggtggtatccggcaggttgaaataccaaggaatatatccgattgcttcacgcacattcgcggaagagtccgtacgcatcgtctcaaaaaactgatgacgtgtattccacaattcattttctaccagatttttcaaagtatctgctctcatgccatatttcatagccatcccctcatcaccggaaagaattcctatacatgaaagtgctttagcattgccatacatataactattgattgtcggccgggcatatttcttcctccgtccgccactgattgattcttccataccatcctgtacgtcaccctgccaatacaatccgttcttcaaacggttcgtacgttcccaacgctggtattcggtttccagatctttcttcatatccagcagatagtccttatcaccatctaccatgtaacgagccaaaacagcatctgcgttccatgagctgaacttatccattttcttcatcggaccgccatcattgccacgataccatgtatgaataatctgatccaaatatttcggatcacgcaaccaacggctttcataaatgtgatgtccaatagcacaagcaatcaaattatatttatcagaataagaacgctgaacgagaaactcggtcatgccatagccaacaggagtctccttgatatgcttacgcaatgaccaccaacgataataatacatttcttcaaagttatgttgcggacactcgaacaaaggaatattttcctccatccattccgaagccttttcattgggaattgcctgaacaatattttcgtcttccataccgttgaaatagtctgcataatgactgaagtcagcatactttaaaaaagcagaagacgcatctttatctgcagaagatgttttcacattggcaatgccatattcagccaatagatcttgcgcacctgcattcggcagatcataagtctggtcggcaggagtatctacagtcgggaatgtacgaggtacgccagtacggaatacgattcgctccacagcagccacgggcgcatagaacatacgcagccctactctcttgccatctacatatacttgaatattacgatcaacagtagaaaggactgcttctacatgataaacctttcctgcttcatatttcatcatatttgcaaaccgggagccgcctttcaatcggaaaatgccatcatcagtaagttccatacgagaacaggctattccattctcatccagaaattcaatctggagtgtgcctttattattctggccggctttcaaatcaaatgatactttcaattctttagaagccggaattttacgttccactttggcataatcaaacggatctttatcctgcaacttcaaccattgatcctccaaagaaacaggggcccaaaccggggaataaatattccagtcagtcagttccgcaattgatttatttttagagaaatcatcatccgcatgtgctgaagcatttatttccaccgggacaggaatacgggaaatccacatatcttccttgttcacactgtaagaaacccacaaatcaccatcggcaggtactccattaccttcctgaataccacgcggatattgaggaccgtatgatttataatttcctccataacgcatgggagtgatttcaccatgcaccagattcaatgttgtatattccaatccatctttactcaaagatatagccagcggccaacgaaattccgacggattatatacagtagcgtatgtaccatcacttaaacgctgtccccaaattttcgcgttgctattgacgaaaccttttgcacgaagcacaggctctgcccaagtatgtccgccatcctcactgatagaggtaagcgcatgtttccaaagactggcaatacgtccatccggcaatgtataacaattgaatgctttgtatcctttcttcagcgggagaataggatcttcacggtcggcttcttccacccactgcatcatatacagcggattgtcaagaatttcctggcaagccttcacaaactcacgatccttgcttttcttaaaatacggataatcagtattcttttcattaaatccatgattataataaatgaaatagatcggtccgtaagaaccgtctttctttatttcacgaaccacccggccaataccgtttccatcattgggatcatcttttttatccaaagcaactccataatttcccattgtaatcagcttgccggatttagaaacatagaatccgacacgctggtgcataatggcaatcagatctttggcctgcacacccggacgagactctttggtgtatccatcgggaacttgataaggaggaaacacaatttccggatttgtccagcgatatccatccttcgatgtcatcagaaaagtctgtgaaggcggtacgtgttcgtcagaaggatctgccaggtattgatagaaaaactgtccattccaataagccagcatcggctgatgattatacgtccatccattgccgttcgaagcatcgggatgttcacgattggcacgtaccaactgaatgttatgtactccgactaccggagacagttgtccgtcgtgacaagcagggttcgataattcttttcctgtataatgaattctatcttgtgcaaaggctgtagtagtcaaccaaccggcagccagtacaaaaagaattttagcagagttgttcatgatttattctgatttaaaattgtttccggatttatttcttttcttccagcaatgcttttacgactgattccggagccgtaaatatggttccatgcttatgccccacagggatgcttacctcttctgttacatctgtaaagttccggaaatccttcgtacgcatagcgccatatatttttttcttatatacatcaaaatagattagataatcgtctcccactttctctacagacggtccttctacaaaggattcagtgaaaggctgggatgcgggcgaataaggaccggtcatagaatcggaaaaagcgattttcagattacgttccggtcgggtgttatccttgagcaccattacatagtcattctttgcccgtttcacgataacggcatcaatggtgctgaatcccggatcgtacaaaagttttgctttcgaaacggttttaaaatcttttgtagtgatatagtataaacgatgattattattctcttcttctatccccttttcgaaacgtccggggacacaggaagcccatacgaccatgaactgatcgttctcgtcgtcatagaaaatttccggagcccatacattaatggtagtcggttcgtttaccattacaggaatcatctgttgttccgaccaatggatcaaatctttagaatgtgcgtagccaaatcctaaatcacctttccaacttgtagtccagaccaaatggtaggttccatccggagtacgtaccatcgagggatcccgcatgagctggtgctgtcccagttccggctttagccaaactcccggaatactgtcccagtgaattccgtcctcactatataagtatcttaacccctcatcagccggttcatgaaacgaagtgaacatgtagtagtctttgttccccccacaagaagccagaaacagaagacttattgcggctaatgtatttcttaactttttcatttctatattctatatttgtatcttttatacagaggagacgatggaaagcgccgtttgtactcaaatatactagaagaatcaatagattcaaaatttatatacgataaaagggcgactctccgagccaccctttccaccatcaaacaaactaaccatttacaatgggaaagaatttcacttctttttatagtatcttattttttaattatatagaacctccacgggcttttatacgtttataccattcctctcgttctttcttcaggtcatatccacgtttagccagatagttgttgatacgtcctttgtattttccgaaagcagcgtgtttcttattcgaattttctgcatccaacgcaaattcacgagcctctatcaaccaagcatagatttgagctttttcttcttctttcaaagtaggaatcatgtccagatgtgagtcataagtcacttttactactccataagtcatgccatccttaacggcttctatttgcttttcatcaagaaagagagataaattggcaggaaaagcgaaatgtgaacgatatagcgccgcatctttttcattttccgcagctttcaaagcttcatttttagcctcaccagtcaacccggattcttttactttcttgactttcgcatcccgcacctcataaatatcatttaattcgaagtaacgattggctatgacattgcgaacatcttcggctattttcgcatctgtaagtccgagtttatcaacgatcttttgtgatcggccgacaatagactttacatattcaggatcacgattctctttatttaagtcgactgcctgcgcagacatccaaccggaaataaaaagcaatgatagtatcagtatctttttcataattacattaattttcctttttcagccaatgtatcgtagttgttcttcatatctctccaatctactttatgctttgtgctgataccgttgatatatttttcaatattcgtatatccgtcaccagtacagtctttattggcatcactcggatcgttcggatttaatccgttagcaatttcccattcgtccggcataccatctttgtctgtatcaacataaggagtacctttgtattcaggatacccccccatctggcgaacatcagtaataataccctgcttataagaatctttcggcaaacgacgatacttgaactgtccgtcttcccccattgacttaggagacaaacctgtcaagtcaccataagcgtctttaggaagtttcttttcataataaggaatacctgttcttacttcttcaatcacacgttcgtcaacaatatcacgacaaggaatattcgcacctacatgtttcaatacatagtcataagcatctttagcccccatgatattgatatacggcatctcgaacggctggtagctacgcatgtattcagtatatccgtcagtgttcggttgagtttcaatctgaataccgccattccagttgtctttagttatttcaggatagccttccattatatttccgtcggcatatactcgcccatattctttatgatccagcttactacgtcctgcttccggtttcaagatacgatgtcctacattggaatccttaggagtagcaggtcccggtttgtagtagttgttaatcatattgaacatcgcggtataatcaccaccatcagaagaacggtgcacccaattgaatactacattattaacgaaattgaatatgccattccagccgatagaaggattacgtccggagttactagcccaaaggttacgggcaaatgcacagttctcaccacctaacgtactaccaaacgcatgattgtatgtatctaacgcttttgccgagatagtattttgaatagttacgtttacagtaggaagtttcaagtctttgctttcatattgtccttcactcgggtcgtacatgtggcgatagaaagaaatgttttcatccaatccccacgtacaggagcagtggtcgatcattatattaccaacagggttacctccgaaagagtcatcacgatgccatactttcgtttctccacgacggaaacgcatgtgacgtacaacaacatcatgtgtatctacccaaaatgactcgccggcaatacaaacaccgtctcccggagctgtttgccctgcaatggttacatagggagcacggacgataatcggagattccagacggatgataccggcaacattaaatacgataatacgtgcaccaccagtttcacatgcttcacggaaagagcccggtccacgatcattcagatttgtgacagttatcactttacctccacgaccaccgaaactgtacataccaccaccttcagcacctgggaatgaagggatatcagcctgtggcaaatcgtacggacgaccagcccaaggaatatatggacgtccttctctagcttctttttgtactatcggcaacgcttttgcccatgcttcatcagagcgtttccgctcttcagtcatcatttttgtatagttttctttggcttcgccagatatttgtgggtattgcgcccatgcaacggtcggagtcaacattgttgcagcaaaaactgctaaaagtacctgtttcttcttcatttttatttggttttgtgaagttgttaattcaaaaatacaataataagacgaaagaagaaaagatttgtaatcagtgatgatgatcttttatcaaatgcgggggagagaaacgactttccagtctccaatggtccgtgtagtactatcgagaatcactttgctgaaaagtgtctttttctgccggtcatttctctatcggaagaaaaaacgacgaaggaaggaatgtgtcacacacgaaatccgaataaccggaatagcttggtgtaaaagaaaagagggaatcttaagattccctcttttcacattttctcttctattagctgccgtcagagagccggatcgggagcttcgccactgtcgctgccaccggaaggaggagttactccaccgccttcatcaggatcgggagcttcaccttcaccaggcgttatcgttccgttgcctccggaaggctttgagggagccgtaatacctttacgacgattataagcagcttttgtttcggctatgacttggttgagagcagtaagaaacgctgaagcttccgttatggagggagtcagtatattgacagcggttatgtgcatcaccaagtcatcgtagagtgaatcaagctgcgcacgcacagtctttgagtccgcaaccgattctgctgtacgagtaacggaacgggcgtctgtcagtgccgaatagtttttattggcggtttcgagtgccgttaatatggcatccaaattgagtgccgtaacggcggttttcacggcttccttgcggaaatcaagcagtagtccgctgatggctgccgtttcctccatattgcgcatgcgtgccagtccggtataagggcgcaccgtgatttccaaggtattatatgcatctcgttgcgctgccaacggtgagtttttggccgcacggacagtagccaacaaataactgacatacgaatcgcgttcggcatccagtttcagtaaatcctttgtttcggcgttggccgtggaacggttcaccaggtcttccatttgtaccaacttcggcttgatgctgttcacgatgtttgttactgtcagtttggaaatacttcctgcggtgaggagtgtcagcacacgattcatgaaattggtgtactcagtgttgttcagttgtgacagtgtgataccgtctgctttttgataacttcccataattttttctttcgggattcatacttgttctatctatctctgaaaaattcgaagtccggacaagcccgcgaaatggttgctgtaaattcgcggacgttttgcatacctgtgaaagcattttttaaaatttgcaggcgtttttcaagcttgcaaaagcgatttaaaaagttttccggcattttacaagcttgggaaagcgtttctggaagtttgcaggcattcagcaggcttggggaagcgttttgagaagtttgcgaaggcaaagataactaaaatcagctgatttaacgaacaaaaattcaccaattcctgccgtcttctcaaagaaaagagggaggaaccggtgaatttctatggttttcgatgccgaagcatcctgtgattcatctccgatgtaattatccctgcaccgaaatgcagggttcttatcgaaggaagttgagttttttattcagccagcgggtcaaaagtaccgtttgcgccaccgttgttgtaatctccccagccgatggtttgcagcaatgtactattattaccctggataccttgatggaaaccaaggatataataccttggaaggaacgcgatatacaatggagaatggctatcatcataagaatcgcctttctttgtcttacgggtcaaataatttgaataaaattctttcagcctatcctgttcgctggcaagatcctttctcaaatccattgcagccggacgggtaattccagcttttactaacggatcgtcgtcaacatttgttccaccaatgccaccgtttacagttgtacggaattcaagattctcgcgacgttgtccgttgagtggcttaaaaccaagatatgtacatgtgtttccaccccagccagtcagtttccaagtagcaggcgcaccttcaggaagttctatgccgccatcaaacaacatccagcgacgcatatcatcgaaacgttttccttcgtatgccaattcaatttgacgttcatacatgatagctgccatacatttagcttggtcaccgtccaaacctgcttccaatccataattattttcagctttataaccaacacgagcacggattttttgtaattgatcaacggcaactcccatctcacccgcattacatgctgcttctgcataattaagtaatacttccgcatatctaatctccatatacggcgcggcagaacgtgtgaatcccccggacttttcatcatagacataacgggcaatagcattcacatctctgtcatcagagcgtttacgtacataaaaaccttttacatcattaaggagaccatcagcgccataggtcacactgctattggcttcaatatcatctacataagctgcatccgtataccaggtatagttccaaagttcataatcaggaccattgtgcgggtatcggttcccttgtgtcgtaggattaccgacaaacgaccaacgaactcccgggaaagcgaatgtacgatagaagcgcggatcacgatcgacgaaaggaaattcgcgataataaggtatatctgatttagttaacgtattgtatgtttcacaagttgcaggtatcttgccgtcagacataggaaacatatctaccaacatggcggaaggtgttttgccacctcctcctctagcattgtacggccggatgccattttcccatgtattattcttacgataatcaggaactccttccgtcagcgtgttgtgtagcgttacaaatacagcttcttgactcggcacttcagtaaaaagattagcccaaccggaagcgttcacaccgggattactttcattagccaagccatatccggcagctgtcagcacgtcaatagatctttttatatcattgtaagcctgtgtccaacgagacaaatcattggagcgattaaataacggactggcatatagtacacgtactcgacccaacaaagccactgctgtaccggaagtaacacgaccgtaattatcaccagacatccattgtccggctcccgtaaaaggtgctaacaatgtttcagctctctccaaatcgtcacaaataaatttgaaacaatcctttgcggaagaacggggaacaacagaactttcaacaggttcctgtacttccgtaatgatgggcacaccaccataccatttcaccaaattataatagcaccatgcacgaaagaagtaaacctgccctaacaactcattcttttcttcctgcgaaagcgtgcttccttcaatgcctgcaatgacatcattaatattacgaatacgtccataagcggaagttataggatcacctttcgttccttcaaagtaatcaggtacaggattatttccggtttgataagtcaacggcttgagtggatcgacaaaagcactgaatccactatattcttcagtcgacttagattggtcgtctgctaaaccggtactgttatacattgaactgggagtagccttaggatctggcagacatactctataaacatctgctacacgtcccagtgcaccactccaataattataagcatcggcagtagtgctgtcaaagttctgcttgtcttgcatgaactggtcgctacaagaagtaaacgcagtcattgcaaaaaaagctacgctgatacggaatatattttttcttttcattttactgttcttttagaatgttaaattgacaccaatcgtgaatttacgcagtgtaggataatttccataagtagtcatcggatcaataaaattatccggataaggattatagaaacttaatagattctgtcctgtaatgttgaaacggcaactttcgatacctatcatttttgtatattttgacggtatacggtaagctaatgtaacgcgattcagtttgacacgtgttccgcttactctccagaaagaagaagttactgcattcacgctgccccatctcaagttcggatatttaccattgcgattggctttcaccactacattacctgctgcatctactacatcgttatacacaaacatattgtctgtagtccagaacgaagacatatttgcatattccaaatcattatacttatttgccgatgttccttggtttcctaaagaaattgcatcatcaggcaagaaactataaccaccccagctcgcattaaactgagctgtcaaagaaagccccttccattctgcgttcaggttcattgtcatactgtaaggattgcttcggttggacaaccgcacctggtcatcttcagagctaaccaccccatccggtccggcgtatgtaccatcatcttgtctggctccacgcacgtctttataaatcaacatacccggttttacatcttctttaacgttacccatataggaagtgatattgtacttggcaaaatactcgtcaatatcctgatagctgcggaacataccgatacactgcataccccaggtgccttgatccaaacggtcacccttcttatagctcttataagtaggcttctgatcccagtctcttaccaaaatctcattatcactatacccggtgttcaactgaattttatacttaaaatccttacctatcttgtctctccatgtagcagacagttcgacaccataagtattcaattctccataattcactttcgcagaattagctcccactgtagatggaacagaggcattataactaagcaacatctcacggttccattcatagtaagcgtcaatattgaatgataaacgattatcgagaacattgaaatcaagccccaaattacctttataagatttatcccaatgagcatcccgattgattgctgcattgtttttattcattgtgaggtgactaccggcattggcctctgtactagtgccaaatactggccctttatccttatctgttccgtaagtctgcaaccattgccatgctgttgtattatcacgaccggtcaaaccaaaagatgcacgcaactttaagtaatcaatccatgtaacgttcttagtaaaccattcttcttgtgaaaccacccaaccagcagatactgacgggaaaaatccccaataattttcaggagcaaacttggtggaagaatccgaacgaagcaggaactccagtaaatatttgttatcataagaataattcaaacgaccgatataagataaattacccgactcaaaacgagtgaattctgtactaggagtactattccagtctaccgaattagattgtcctgtcgtaaattcgtatgggttagtaaccataccgtacaaatattctgtttctgattcagacttttcaatggagaataaacctcctacagaatgtagtccgaaatccctattatatgctgcagtaaagttcatctgatagttatccgaacgagtcatggaacgagacaaatatccagtaatatcacttgtactggagttaaccaccggttttccactatttgccaaataaaaactagtattttcaaatgcactgttatccgctccttcaattggagtatacaaatgttctccactaccagaacgagtctccaaataataaagattataagaagtaccataatcatttgtcttattcgtattgacactcttcgaataagtaaacttcaatttcagtcctttcaaccatttattccatccgaaatcgtattccaacccggcattaatattcatgtttgatgtcatgtttcgtttatagtcgccattattctgaagtacattgaaattgtaattctgaatattacttaccgatgaattagtaggaccgtaagcagctaccgcatattcacccacatattcgggaatataataaggatgtgtcaacagcgtattgtaatctttctctgcagacgaacctccgacctgattcagaggagtatttttctttccataatcaccggagacctgtacattcgcttttatccacttgctgattttcacatctacaccagcacggtaattccaacgattgtaatccagcttacctaagttaccatcctgatcaaaataagaaattccggcaaaataactggctttttcagtagcaccgctcaggtttacactatgctgctgcgtcaatgcggattcccaatatttatccagtaaatcatagtgcaaacttttcatggcattcaactcatcctgctgaaaaatagctcttaacggatcaatacttgtctccgtcgggtcagccatacgtactgcattccataacttgccatactcatacgcattcaacatcttaggacgagatacttcatctgtaataccaaatgttccattatatgaaattttaggcgcacctaactttcccttttttgtggttaccagaataacaccatttgctgcacgagcaccgtaaactgctgcagaagcatccttcaagatagaaatactttccacaactgatggatctaagttgttaaacgcttccgcacccaaattagtataagtacttcccacttttacttccgtaggataaatgtaaccatcaataacatacaatggctgcaggttggtacctcccatttcttccaactcaccattctgacgaatagtaatcgtagcgttttgtcccggacgagtatcacctccgtttacagagataccatttgccaaaccgctcaatgtactggccaaacttccacttgaaatatcctgaatatcatcaacgggaacagtggcgatagcaccagtcaaatgcgctttcttctgcgtaccataacccacaactacaacttcatccaattgctgcgtatcttccttcaagatgatctttgtcaatttgaatggagcagaaaaacgttgtggtacatatcctatataagagatttccacttccttaccatcaggaacattcaatgtgaaatttccatctaaatccgttattgttcccactgttgttcctacaacctttatggcagctccaataataggttgctcggtctcatccagcacaactcctttgaatgttttagtattctgtgctattgtcggcaaagccatcacaaaagctagaagcaggctgatactgattctatatatattcttatgtttcatctttatcgtattctagatttattatctttttaatttaaccaacgcgggtcgccactaccatgagcaaatacttcgggagcactcggagtaaaatcaccgtttgcagcatcagcgaatcccggatccacgccataagcagaattgctcttatcaccatccgcacgatttgaagtctcatccagtggcaatgcgccattgtaccaataacagttattttcaaaagttgcagctacctttgtaccctgcattcttatacgacgattgaaatttcccgaaaatgagtcaataaacaaattgttctttgaaattacctcattatgtgtctgtgaccaaccattgccattaaaactctgtccggaataggagagattatagaatgtattgcttataaatgtcatcgatcctcttgaccaaccatcataactggttgtttgtccacctccataacgtaaaaaacgagaaccgttttggttatgactataaatcgtagagttacttatttcgaagtctttcacaatcgaactgctagagttaaagtttatcaggtcagcagcttgatagcaatctattacacaatttctgattgcaaaattttgaataccatacttctttccgttaatgtgaactaagtattttctaacagccttgatattgcaagattgaataaccataggattagttacttttccatgatcggttctctttgtatccaatatctcttccggaacatcaccaaactttaaaaaagccccatctgtcactacatcacaatcaaagttgataaacttcaaggctaatcctccaccacaagtaataatagaagccggagcagtgaatttcacattcgcattcccgcgtgttttatttccgcgcaactgtacattatttacgccaaagttcaaatctcctgaaatataatacgtccctcctgcttccagttcgaaagcaacttctgtatcttttcccgtagtcaccggatgttcagcaaaatatgtagtcaagtctgtaccattaggaacaagcgttgcggcaacaagtgtagaccaactgatttcagtggcggaaacggaagctgtattattcaacttttcattccccaatgctgcaatctcaaccttatagttcgtatcttctacccaaggacatactacagccgtcccgtctacaatactgtccttcactacagctacaggatgatcagggtcatctacaatgtacatagaaaatttataaccacctgcccccataacaacagaccaagtaacttttacattattttcagttgtagccagtttttcaaaagccacatccgatgctttcggcgaatccaattgcgtattcgtcacgccaccggagaaggtttcttcatcaaaaccatctccagcgcaagagcccataaataaaatcatcgataaacaagctatgctcccgacaactttcattttaatcttcatcttactcttcatagattaaattttaatttaaacaaaaataatacattatatcttcaaaatctaaaagttcttttaaggaaagacgtgcaatcaaaaaatatgtaatcacttaaaagaataaaaaaatagattttgcacttttttctctctctttgtaatattaactatatcataatatcctcctatctctgttgaaacacttctttcaaatacttaatattcgtaccataattctttttcacgttccgcacgtcattcttgtcacgcgaacgttctaccaccagccatccactccatcccatcttatccagtgtctttttcaccttattcatatccaatcgttcattataaggtaaagtcactccatctgtgtccgtacagtgaatctggcaaatcctctttttccccagaatcttcaactccttgcacaaatcccttccattctccaatgcattttgaaatttaaaatagatcttgattccgggagaattaatttctttcagtagtttcacatctccttttgcatccaattgagtttcaataccaatcaccactccttcagaagcagccatatctcctatctccttcaagcgttttacaacttctgtccgtagtgccggaatcttttcccatccggctttgattcctcccaaaggaagaaaggctactttggcattcatcactttcatggcacaaaggcaatcctgaactaaatcttcatagttagcccgctccagaaaagactgtccatagaaaccggacatagcaatagaagaaacttctaattgatatttttgagcagtttcacgaaataattgctggaaatggggctcgcgcaatttattatcaaacatttccctcttgccaaggccacccatatccaattctacaccgtcaccattcaattcatgtaccaattggaatgaaccgattttctgacgtttcagaatcatccagtcacatacggctattttataacgttgttccttttgctgcgatccggcaattgccaatagaggaaaacactctgcaagtatcaatatccaaaggatatgtttaaataaatttcttctcattttttattttattgcatacgatttacatagtagacgtatggaatagatttttgtaatcacctataaaacagagaataactaaaaatactacggagtataatttaataaaagtaagatagtgacggtatccaagacaaatagtgacgctatcttggtccgataccgtcactatcccgggcatataccgtcactattttcgaagaagtaataacagaagtaaatgtaaaaaaatgggctgccggactattagaagtccgacagccctgtcaacccaaaaacgatacctatgaaacactgtgtgttatttcaaatcaaactttaaatatttgccgtgaacaagttcatcatgtgtgatatgatatttattgaacttcttgccattcaatagtaccttattaatatataaaactcctggttgagtacgattggtttcaatcaccaattcgttttctttataccatttcggatctaaccggatcgttaccttattaaagaccggagtcgtcaatgtatattcgggcagtccgggacaatccggataaaaaccgatcatattgaaaatagcccaggaagacatcgttcccgtatcatcatttcctggaataccatcaggttttgttgtaaagtacttatctaataaacgctgcgtctctttctgcgtacgccattcttcacctttaaagtatgagaataaatgagcataagcaatatccggttcatttgccgggtcgtaaagtccttcgtcaaaaaccatttgtagtttatcgataaaaggtttctttccccccattaatttcgccaagccatatacatcatgtggtacatagaacgtataattccaggaactaccttcatggaaaccgggattcggttcaaagttctctccttgtctcggattaaacgggctataaaacgttccatcggggagaatcggacggaaagtaccaaattctttactataataatgtttgtatcctaaagaacgtttatagaacatctctgcatctttctttttacctaaagcagctgcaaaacgagacaatgcaaaatcggcaatataatattccaatgcatgagagacggaattgtcatactgttcacgaaggggtacatatcctttagacatataatcatcattatcaggacgcatcaagttttccgcccccggtaacgtagcagatttgtacattgcctcataagccaaatcaacatcaaagtcacgcaaacctttcatccaggtatctacaattaccggaatactcggatcaccttccattgtcaatgtttctctgccatataattcccacttaggcaaccatccatgttcacgatacatatcaagcattgtgcgcaccatttccatctgacgttccggataaaccaaggtcagcaattgatgaacattgcggtaggtatcccaaagagaaaatacggtatagcgatcacctttggttgtcaggatcttatcactttccattgccggatattctccgtttacatcctgcaaaatattaggatgaatcagcaaatgataaagcgctgtataaaacacagtcttttgggcatctgtaccaccttccactgttatgcgtgacaagtcatgattccatttggaacgtgcttccgcatgaatcttctcaaaatcctttccagcctgttcacgatccagattcaaacgggcattttctatgcttacaaaagaaactcccatttgtacttctacttgttcaccttcttctgtatcgaaggagaaataagtaccaatgtcatctcctgctatttcttttccgtagcgagtataaagtttatactttccctgatccttatcccattcagcctcaacccccatcatcggacgttgtttcttccaataccctgttgcagaaggattcttcttaacccgcaatacaaagtaaatggggaatacagcttgaggattataacaaaatgtaccaagtagtttgactccttccacttcgctatcgcttacacgacgaagcatagcgccactctcattcgttaacccctcacccagattcagcaggatgtggcttttcccttttgggaaagtaaaccgggcaataccgctacgcggagtagccgaaacttctgtttttacattatatttagtcagataattagaataatagcccggtgaggcctgttcatccttatacttactaccatattctttataatccacattcagttctccggtagtaggcatcaataataaagaacctaattccggacaaccgactccactcaaattcacatgagcatatccggtaaagaaacaatttgtatattcataaggcgtagaccaccatcgggcatctttatcgtatgtgttttcggaagatcccatcacattgaaaggaaccacagacatcataccattggggcaaatcgctcccggattggtcgttccgaaatttgtagttccgataaaaggatccacataatctatcaaaagacttttatccgtatttttaaggggagggctccccccttcccccgcataggcggaaagaagggaaaaagcaagtgtgtaagttaatataatacgtttcatatctttattaaatgatactcgttcgtttcgtaaaatcaataatctcttttatatatccgaaggccatacctaccacagtatctgccgcaccataataaacagcaacacgttcaccatcttgcaaagcagcacaggggaatacgacattaggaacgtcaccttgaagttcgtaaggagcagccggaccaagcagatattcacgtgtacggtaaagaactttttccggatgatctttatccaatatggcagctcccatagcgtaacggaaaccattacaagtagtgattacaccatgatagaacagcaaccagccttcatctgtaaggaaaggaactgaacctgcaccaatcttcgtacactgccaagcgctttccgggaaaggagtcactttcattacacaacggtgttcaccccaatatttcatatccggactatagctgatgtatatatcgccaaacggagtatgtccattatcactgggacgactcaacatcgcatacttgccatcgatcttctgcgggaaaagtacaccattacgattgaaaggcaagaaagcattttcgcactggaaaaactccttaaagtcaaaagtataggcaataccaatcgtagggccatgatagccattacaccaagtcacccaataacggtcttcaatccatgtaacacgagggtcgtatttatattccgactcaatcatttccgtgttacctgctttaaactgaataggttcatgattgatatcccaatgaattccgtccttactaaaacctgcaaagatattcatctgtacagctttgttatcacaacggaatacgcctgcaaaaccatcctcaaaaggaacaacagcactattgaaaatactattagatgaaggaatatgataacgtccgataactggattttgtgagtaacgccacataacgtccgtacatccgacaggacgatcttcccaaggaatttgaattttattcataatcgttgattttatattatttattttttgagtcatcatacgtgaaaggtatgaaataagtaatcagaaaagctggaatagttgcaattaacacatagataaagaaattacgatatcctaataagtcactaagataaccactaaccattcccggaagcatcactcccagattcatgattcctgaagcaaatgcgtaatgtgacatttgatgtttgcctggagcaatctgttgcatcataaacaacgtcagtccgacaaaaccaaagccataaccaaaatattccattgttatacaagttccgatcagatatacattagtaggctgtgcaactgccaaaaaagtataggctacaaacggaagattaaaaatacagcagagagtaaatagtgtctttttcaatccgaacttagaaacataaatacctgccaacaatgagcctaaaacgaaagcagcggaaccaaagataccatttagcgtgccgatctctgttaacgacagtcctaagccgcctacatcccttgaagcacgtaaaaacagcggagctattttcatgataaagccttctgccaaacgatataaaataataaaacagatgtaataaagaatatgctttttagtaaagaagttagcaattactgctaccaattcgtgtccaacctccgatgcagttttctttgttgttgacggaacctgtgtagaaggtaacatttttatatgataaataccgatcagtaccattattgccgcaattacgccgaaaataatcatccatgcagatgaatacgctcctttgttaacatctatcgaagcaccttctattgctccgaagtgctctgccaatgctcctgccatagcaactaatcctccattagcaaccaatttggctacattataaaaagccccttgaactccgatatattttgcctgatcttccttgttcaattcagccatatatacaccatcacaagcaatatcgtgcgttgctccactaaaggcaatcactgccatcgtagagatacttatagcgaaaaagtaatcaaaaaacaaagaaaaggctactactccaaacaatacaccactcaataattctgtaatcaatacgaagaattttttcgtccgatacatttcaagaaaaggactccacaaaaatttcagtgtccaaggcatcataatcagagaagtccagaatgcaatttgcgtatccgaaattccaagatccttaaacatgaaaacagaaaccagattaatagcaataaagggaagtcccattgcaaaataagcagtaggtacccagcaagccgggttaatagtttttcgttgagaagcagttttattctgttgcataaatcatagtatatagatgaaaaaaaacatttttctgacccatctatatataatacaactaaaagggggaaactactaacgtctccccctactttttttattttattatcacttcgtctataaagaaccacgaaggatggcctacaccataatgccaagtcggacattctttcgttccggtgacttctacttttacataacgagtttttatcggttcggctgattcagccttgactccacggaattttacctcaccggtacgttcttccggtaaatcaatcgttttccaatgcgtataatgttcaccgtcatcagcgtatgaataaaccacctttagaggaaaaagaatccaggcccctatttgatgaagaaaatctgtttccacactttgtatctctttcgcttcgcccaaatctataacgaatgcaccatcggttccttcccaaccaatccagctatcaacaaaggttgctccaccaaacaaaccgtcaaccaatgctttttttcctaatgccgcatattttcccgtaggaggaattagataagtaacttttgcacccaaagccaaacttttttctttctgcggcatgtaacgtttacgatacaatttgcaatagtctaccggtgaattggaacgctcattcaatgtaggaacttgaaactctttcacgcgttcctcaaaaaggtctaactttttattgatatctaccaaatctttttctgtctctgttcgtgcaatctccagttctgaatactgaattggcagacgtgcccgttgaactcgttttaagaaatcgggatctgctgcaacagccttttcagccaaatcaaataaatgattataacgacgcatcaaagcaggctttagcatgccatacttatgtgatacgggtgaatcatatatccacaaccgctgtccactaccgattaatgcgccttccattatctttatgtactgataaagatatggcgctgcttcaccataatatccatgcagaaaatgttgcatcaatgagtctacattaacttctggattccacattaactttgacactaaataagcacgaagttctgcaaaatctcctcccctgctccctgctatttgagagaaatgcatggtggcatgattctttttgaaaagacggatattgtcctgtaaaatatggaaattaggaaatggagccagataattatcaaagttaataccgtaatcccacacgaaaatattattggtaatcttagaccatccttccatggctttcacaaactcttttcccgaagcattctccgtcaaagttacttcacggtcacagtcaatatcacacaacataatattcacatttggcaaaggtttcacacgcttcggaggattcattgtatatagataagccaatgtggaaaactctttatccggaaaacgggcagccaacttattcagaaaagtgatgatgcttcctgataatgctccttcataatcatcaattgccttacaagcatcacacgtacaatttgtataattaccatcattctgacttacagacatgatatgcttatctggatttgctttgaaaatagaatcaacacgttgagctacaatctcaaaaacctccggattactcaaacaccactgactggcctttcccgggtggcgttttcctttgaagtaagaataatattccggatgttctttcccataaatggatgaaggcagaagcttatcaaaagtatgcacccaataaccggcagcaaacacttcattcggttcctctaaacgattccaccacttataaatagagtctgtatggatagcataacattgtgtctgacggtaacgaaagcccggattctcgactttattaatgaagggtaagttcaccgtttttgaaggggtaagagaatattcattctctccccaataatcgataccccaatattgctccaataaagtaacaaccccatatacaacaccgttttctttaccagatatttttagaataccgtcttgagtagaaatagagaatccgtcctctgttacttccgccggagattgaccaccaatgagaatatctccttttcgaggagttttatcattttcaataggaagtgcaactcccgaaatttcagtaagaaaacgttgtaagaattgtgctgacgtcttactatttggcatcttgtcctgcacaatgatgcgagcactacttttgccatcttttacgagtgttatttgtgctgaaacagtaccacataccaccagcaaaacagataataaccaatgtttcatgtttgttagaatttaagtttatatgagcatttactagaagtacaattcaggagaataaagttctaataaattatggatactttaacatataaaaaagaggatatgcctctgcgacatatcctcctctttcaatgatttattagcctagaacattttatttatcaaatcggatattatgttcccacctttgaagcgcaccattagatgttgcattgtgtccgtttcctgtagcatctctaaaggaagtgccatctccttcatccattggccaaagggcaatcaaattaggattcttaggatttacttcaaaatacatattgtttgcgatctccgattctgtacgagctactttccataggcgaacctgactcatagcacaattattacggaaatagctaccactatccactattttcataaaatcaaagcgtacgcttccacctttcggtgcaggaggatcaaagaaggtatcttgttttccattcctataaatggtaagtgttgttccattataaacgaaagcccaatgataccaagtgtttgcttccaaatcactggctgtttgtttttgacctcccaaagactttatctgtagataattgtaaggcctattggcatctccaaaacggatatagatttcatgatcattacttccggaagtgaaaatagcctgattatttatactataaccatccatacgtacccatgcttccaatgtccatgcatctactgtaattccccaatccgtttcaggaagtgttgttacatttccggcattaccacgtaatacaggaacagaaacattcaaaggcttagctaatacataaataaatttactttgagcttttgattttacaatattaccttttataacatttcctaatgtaagaggaatggcataagtaataccattagtcacaaaatcatccacatgaagtcgataattagcactaatttcacctgccggaattatcactgtcgcattctttggaagcatatcggctggcaagacttcatattccgtaccgctagttgcattgtattcagccagtaattcaggagagaactggatttccacttccacatcttccataactttttgagctaaacgcacaacaacgttaatgtctgcaccatcatccatggtaacagtagtagcattgtttgtaccagccgcatctgttatgtaaaggctgtttgactgtgccttgtattctgcattctcacatcctataagaaagaatgctgacaatgcaatcataagacttgataaatagatatatttcataattttcattcttataaaattcgtttaatcattattcttcgttggcagcattcatgcgatcatagaaattcctatatatgtttgtaattccctgacgcaagaaataatattccggtgaaccatcataatcgcccttaccttgtgcatagtcaaagcctacacgataaagaccacatccaccaattaactggtctatttcataaggttttccattaacagtataagtatttttatatacgtagtttgacatacccaggaatcctcctccagtattagcatacgattcaaaattctcggtagctatggttctacggacaatttcatccggagtaataatcccctgttgtatccaatcatccatatcacgcaacacgcctgtcattctataatctgccattccaccataagcttgcaatacaaaatagtctacatagtatgaaagccattctttatccatacctgttcggattccaacctcaccgtcaatcaagaaaagaaggcgtttctctggcatagggcgatctccacgatcgcggttaggatccatagcaccatgtccaaaccagtaggaaagttcctcgacaaaaatagttctctgtactttatttgaccaaagcggaccaactcccattccaccaccaggctcataatcccagtcataaccatcatatccacattcaagacaagctttataaatatcctctgcataggctttaattgcaggtctcaccttttccggatcactactggttccagcttcgtgataaatttctttatctggaaggtcgtcgcctatattttgagaaaataaggtaacaacaacctttgtgcctttcactttttgtacatattccatatcagcctttcgctccgaagttaattcaaatttcggatgcccaccccagttggaaacaatggttacagaatcaggtagacctctcaagctattttcaccggtaggggaagttcctgtccaattgtcgaaccaaacgaacacttgtggaagtcccggtgtttctttccacttgcgcaaagcagcataatactcatcagttttaattgtttgattcaaatcaacatcattaatagattccacatccgtacatccaacgaagaatatagcggcaaatgcaaatccgaatgcattttttatatgctttatattcatattctatattttatcaggttaaaaattaattctttttcgcccaccacaaatctgtagctccggtgtccggaccacctaacatagttgcaatagctgcttctacattggctgagttactagatttttccgttgtaggatatggtaaacgacgtaccatacgtttactatcaatatcaccgatataaccaacagagcttagattatctcgcgccgtaaacaattcaggataaccagttcggcgataatcacaccacgcttcgattcccaatggatagttggcaatccatttttgagtaataatcttctgaagtttattacttccgttttcccatgcaacagtaggaacatcagtaaatgaaatattattttgagagttccatcgatctgtatacccttgaggaacaactgtacttgaaagataatcaccaatctctacgccatattgattcattgaaatttgaataccttgttcatagtaactcttagctgccgctgttccacctgcaatccatccttgtaaagccgcttcagcttttaagaaataagtctctgccgcataaaaaactggcataggagaagcatctgttacagctggtttagagtaccttgcagcactaccttcaacgcttttacttgtatctttaatacccatacgtacaccacgatactctctatacgaagtcgaagtattcatatatttgctgatacgtggatcattatatccattcatgtatgcagaaagtgttgcattgatagctaaatcaccccaatctgaagcaatccaaaatgggttatatggcatagatggaaaaaaggcattatcatcattagattctattactccgccatcaatcgcttccgccatcatttgtttggcatattctgtatcttcagtattagaagcgatacgtacggccatacgaagttttaaagagttagcgtatttgatccatttgctaaaatcaccattatatatgatatcatattcggcaacaggtacctcttttccttcattttcctgaacaaatgccgaaagtacattgatactacgtgtcaaatcatcaaacatattatgatagagtgttttcacatcgtcatatgccacttggaattctccttttcccatttcagagtaagggataggaccataaatatcagctacacgaagcataacaccgacccgcagaatagatgcccacgcataaatatatccggtacctcctgtagattcttttattgtctggaaattcggataaaactctgtaaacatatctttataaggaacatctacccagtcagcactaggattgaatgttccaaaattagtaccattccaaggagcagttgttgcaaaatacccgccatactgccctaccatttgttcagtgtgttgactgttattttcctgacaggcattcaataagcgagtcatagccacaaacaacgtaccgacccgttccgtcggagtcatatcttcgggatacacgtctgttggatgtgtgtttaattcgtcaaagtttcccgtacatgaagcgaatagcagagtagtagtgaaagctgccacgcttacagtcttaattatattgaatcttttcatcattcgttgctttattagaattgtacttttatactaaatcccatgtttctcaagctaggttgcatgaaataatccacaccagtatagaatgtactggtagatgacgcaaccaattcaggatcgaacggtgccttacaatatatcatgcccagattatttccgattaaacctaatgttacatcagcaatgttatacaaccactttttagggagtgtatattcaagactaacctcctgcaaacgaatattggttgcttcatatacatagtggtcaccttcaccagtaccagccgctactatgccgagataatccttagcggatacatttctgttattgatggttactcctccagcctgacgaagttgtgcgctatattcggaaacaccacaacgatcaaggaaagcttgtgtattagatacaaccaaaccaccaaaacgtccgcttaacaatatattcagacgtaaacctttataagtaaatgagtttctccatcctaaattaacctttggaagcaatgaaccgattttcttatattcggtttccaccatacttggcaaacctgtcttggcatccaaatagatataaccattattatcgcgtttaaagtcacggttgatatacaggtctcccatagaaccaccttctgtcaggcgtactaccggtgaagtagagcctcctaatcttgctttgtctacataaggcatttcaatcggttcccccgtaattctgtttgtaacaccatcagccaatcttttaattttattcttattataagtaaaagtaaaattactggaccaaccgaaatcacgccactcatttttatatcctaaggccatctctataccttggttctgtacactacctgcttggatgttaacagccgtatacccagaacttgccggaagaggcgcagcgaatgtttggttacgtgtatcagagttgtaataagtaatatcaaaattcaatgtattcttgaagaaacgcatattcaatcccgcctcataagatttagtaatttctggtttcaaatcagagtttggatacaaagattctgctttatattggtcaagctgatcatcataaacataacgtacctttgtcaaatatggatcataggcattacccaccgaagtgaaagaaaaacgtgcttttaagaatgagaaccattcaggcaaatcaataacttcactcaaaatgcttgaaagaccaatagaaggatagaaaaacggtttatttcctctttctgaaagagccagagaagaatcccagtcagcacgtccggtgagacttaagtagagaaaacttctccagcctatttccgcattagcaaaaactgattgtgtctgacgctttaaaccatcagcatctactttataataaccactgcgtgtaaggttttcgatggtaaaatgattagttacattgttcaagtctccatgcaaagaagtcaactccatacgaagatccttaatagaagcacccaaattggccgttacattaaattcattgaacgttttattgaagttcgccaatacatcagcatacacttgtctgtctagacggttttcttctttatatcgcccttttggaccggcaaaattaccgaccgtacctgcgtggaatttttcggtgtatttactttcggtgttatcgatgctcacacgtccttgtacatttagcccttcaatgatattatattgtagactagcagccaatttataacgtcttctatcgttctcacgattcatacgattcataatccaataaggattttgagacgaaacaccgcctaaatcaccatatggccaatactgagtatttacacccgacaaatcatcataacgttcgtatacagctacatcagaaaaatcttcgccacgtgggaacaagtacaaagaagtaagtgggttaaaatactgcccttgcgataccatattcttatcgttttgaataatatagttagcacttgtatccaaaataaacttattattcaagaagttggtagtattacggaatgagaaattatatctatcatagtcattattgggcataatgcctgttgcattagttgtggctacagagatatagctttgactcttatcattacctgtagagagagaaagtgcattggatacattgcttcctgtattaaaaaaatttgcaggatcgtatctcttatcagtttctaatccccagctcatcatttcacctgtcatattaccataagtattttgaaacttaggcatcatcataggatcactgaatgtggtattattactataagtcacggttgtcttatcagcacgtcccttcttggtagtaattaatactactccattagctccttcatatccatacaatgcagctgcagaaggtcctgtcaacaacgacatgctctcaatatcatccggattaatgtcagctattgattcactgctcggttgtgtagccatagctccatcacccccggaagaagcacgattatacattggaataccatcaatcacatagagagcgttattattctgcgtaatagatttagcacctcgcattacaacctttacaccaccgcctggacctgaagcactagaattaatctgtacccctgctgctttaccagccagtgctcccataaagttagtactctttacagttgtaagttcatcccctttcacctgttgtacattatacgtcaatgctttctctgaccgcttgatacccaatgcagtaacaactacttcatccaatacttgcgtatcttctcctagggtaactttcaagggttgtgcgttggtaagtgtgattgcttgggaggcataaccgatataggatacttcaagtacatcacctttagctgcttgtattttgaaatttccatccatatcagtgatagtaccatttgaagttccttttaccaaaatactaactccaatcaatggttctccttttgaatcagtaacagtaccacttgcagtaattggtgtttttttctgctgctcttctttattactcttcgcagaaagtacaatatgattatctactattgaaaaactgacattaactcctctgaataactgattcattacattattcaaagattcttttgttaccttgatagatatgacacgatttatatcgacatcatttgtgttatagactactgacattgaagtttgtttctcaatttctttcaaagcagtgttcaagggtactttcgatagattaagagtgatcgttcgttcttgcccataagctgaagcaaaacacgaaaccaacaaaaggaagaataacaagtatgaaaacttgtgttttataatttctttcatcttattctttttaattagaaatagtttttagagaatttgtaattagaggcggtaaatgagattaccgttttcacacaaaggtttcatgtatctctgtttctcataattaataaatttaaaggttatacttaaaataaattccataagcgcttattcaatagtaatacattttatgttgtaaccttactaaacgaagataagatttttttcgaaaaaaatagaatagaaagattcctaattgaaaaataaatactcaaatatttgataaatagaatcttatgtacttattaaaatcaggctgatttattacatttgcatacattttgcatacaatatatgtatgctttacctattgtatagatataaatattcattttatgttcaaatattcaaaagatggaatttcggttttaaccatattagataccagaagagcaaaaaagagtggacagtttcctgttaaagttcaagtggtatatagaagaaagcaaaaatattactcaactgggaaggaagtgtcaaaagaagattgggcaaggttattaaaagtaaaaagccggttattggcagaaattcgatcagatatagagagtagtttttcaactattaagcaacaagttaacgaactgatacaaaaaggagaatttagtattgaaacattaagcgccaggttaggaaggcagatgaatgatatgactttgcgcagtgcttttcgcttaaaaatgaaagaactggaagccaatgaacaagcaaacacttacttaaattatcaaagtgctttaaaaagtttagaagatttcggaggttccactatacctttggaaaacattacaattgattggcttaaacgttgtgaaaaattttggatatcagaaggtaaaagctattcaagcataagtatttatttccgagctttaaagtgtgtcttaaatcgtgctgtacatgatggtatcataaaagaatcatcttttccttttggaaagaataaatatgaaattcctgaagggtgtggacgtaaattagcacttactctttctgaaataaaaaaagtaatgtcttatcaatgtgaaacaaaagatatagaagaatttagggatctctgggtgttttcttatttatgtaatggcattaattttatggatttattatttcttcagtattcaaatattatggatggagaaatatgctttgtacgctctaagacatctcgaactaccaaacataacaaagagatacatgcaatcattactcctgaaatgtggaatattattcaaaaatggggtaatccaagattaagcccgcaaacgtatatttttaaatatgctagaggaactgaagatgcctttgaaaagattagattggtacggcgtattataaccaaatgtaacagaagacttaaaaaaatagcccaagacattggaatttttcagttgacgacttacacggcaaggcattcttttgctacagtattaaaacgtggaggtgcaaaaacctcatatatttctgaaagcttgggacactctaacttatctgtaaccgagcactatttagcatactttgaaaaagaggaaagaataaggaatgctcaattattgactaactttaatctctagattaatacatttgcatgcaaattgtatgtacaatgaaaaatggaccaataattgatataggataaaagtgagtataatattaaaaaacgcatattcagattacctataatttagaatatgcatcttgttatcaggagtgttttgaaaaccgcagggatttccactttagccaaacataattcaaataaaaaaggataatattattgcaaattattctttttatcgcccgcgtagtgatagaatagtatctaatattgacaatattaatcaaatgaaaagattccgttctttgtattatcggcactaactagaagaaaacaactactataaaacaagttattattattctttaaatgatttgttaggttccatttaaagaatcaaaatgttccacaccgagaaacgaagtgattctcggtgtggaacattcctgagaaaacgtcttttatcgaatattcataccgcatatatgaataaaaacaatttaattactgcatattcatgtgcaatcttactaactttttctttcattcattgattttgctcaattgtatttagcctgatatcttaaaaatagaacatctaatctatttatctaacaagaattggatctagaaaaagtatatgaaactgattttctcccaaacaatcacgcttgccaacgcacaacctataaaagtaaccttaggagaagatacgcaagtattggacgaagtagttgttactgcattgggtatcaagcgtgcaactaaggcgttaagttataatgtacaagaggtaaaaggtgacgaattgacagctgtaaaagatgccaattttatgaattcactatcaggaaaggttgccggtgttcagattaatagtggtgcaaccggtgctggtggtgccacacgtgttgttatgcgtggtatgaaatctctgactaaagataacaatgcattgtatgtaattgacggtgtacctatttttaatacaggaaaaagcggtggcgaaggattatttggagagatgggaggatcagatgctgttgctgacttaaatccggacgatattgctagtattagtatgatgaccggtccttctgcggcagcattatatggttctgctgcggcaaacggtgttgttttaattactactaaaaaaggccaaacagagaaaactaccataacagtatccaacagtactactttctctaaagcatatattatgccggatatgcagaaccgttatggtacaagttccggattattcagctggggagaattgacaaaccgtcgatataacccatctgacttctttgaaacaggctccaatgttatcaattcggtagcattatctacaggaaataccaaaaaccagacctatctttctgcttctacaactaactccggtggaattcttccgaataactcctataaccgttataattttacggcacgtaataccacccatttcctgaatgataaacttactctggatatcggtgcacaatatatcgttcagaacaacaaaaacatggtttctcaaggacagtattataaccctctcccatcactgtatctattccctcgtggagacaactttgacgaaattcgtttgtatgaacgttataatactaactacggctatatggaacaatattggccttatggtgatgcaagtttgtcattacaaaatccatattggatacaaaatcgcatcaaccgtacttccaacaagaaacgttatatgatgaacgcttctttgaaatggcaggctacagattggctcaatgttgtcggtcgcgtcaatctggacaattccgactaccggaataaaaacgaaaaatcagcttctacattaacaacattctgtggtgtaagtggtggttttgaagatgccatgcgtcaggaacgttctttatatgccgatttcctggctaatatagataaaacatttggtgattttcatttaacagccaatgttggtgcttccatatatcatacttcaatggatcagttatatattgcaggtgacctggttatccccaacttcttccagatcaacaatattaatttctctgccaactataaaccggatcctaccggatatgaagatgaaattcaaagtatttttgccagtgctgaattaagttggaaaaatcaactgtatctaactgtaaccggacgtaatgactgggattcaaaactcgcattctccaaacaaaaatcgttcttttatccgtcagtcggtttatcggctttattatcagaaatggttaaactaccagaggtgatttcttatgctaaaatacgcggttcgtatacagtggtagcctcttctttcgatcgtttccttactaatccggggtacgaatacaacagccagacacataactgggcgaatccgaccgtatatccgatggacaatatgaaacctgaaaagactaaatcctgggaaatcggtttgaacttgaaattctggggaaatcgttttaatttagacgctacttactatcgttctaacacactgaaccaaacatttaaggtagatatcccctcttcttccggatataaacaagcgattgtacaagctggtaacgtgcaaaatcagggtattgaattagctttaggattcagtgataaatgggcaggattcggatggtcttctaatgcgaccttcactctaaaccgtaacaaggtgaaacgactggcaagcggtagcgtgaatcccgtgacaggagaagctatccaaatggatgaaatgaatgtgggttggttaggtaaagagaatgtagctcctcgcgtcatcctgacagaaggaggttccatgactgatatctatgtatacaaccagctgacaaaagacaataacggtaatataaaagtcgatcagaatggtaatctgggtatcacttcatcaaacactccggtaaaagtaggtaatctggatgctgatttcaacctcggatggaccaatcatttcacttataaaggaattgatttaggagttgtattatcagcccgtgtaggcggattagcttattcggctactcaaggtattttagattattatggagtatccgaaacatctgcaacagctcgtgataatggtggtatacctattaataacggcaaagttaacgcccaaaagtattaccagactattggtacgggtgaaggtggctacggtcgttattatctatatagtgcaaccaatgtacgtttgcaggaattgagtctaaactatacacttcctaaaagatggtttaaaaatgtggcgaatgttactttgggtattgtaggacgtaatttatggatgatttattgtaaagccccatttgacccggaattgtctgcctctacctccagtaactattatatgaatgtagactactttatgcaacccagcttgcgtaacttcggttttaatgtgaaagttcaattttaaaagaaaaagctaatgttatgagaaaatatttaagaaatatcacagtcggtgccgctctgttgttactggcaggaagttgtaccgataaatttgaggagtataatacgaatcaatatcaaattcatgatgcagaccctgcgactttgatgaaatctatgattgaaacaattgtgaatattcagcagaatgactctcaaatgcaagatcagatggtgggacagttaggtggctatctatgctgttctaacacatggagtggtacaaacttcagcacattcaatcagagtgatgcctggaatgctaccccctggaacactccgtttgaaaaaatatatggaaactttttccaaatacaagaagcgacaaattctacgggacattattatgcttttgcgtgtatgatacgtgcaataacaatgcttcgcgttgcggattgttatggaccgatgccttacagccaagtaaagaagggtaatttctatgtatcttatgatacccaggaacaggtctataccagtatattaagtgatttagccaatgcagccgatgttttgtacaactattatgtagaaacaaatggtaatgccccattgggagccaatgatccggtttttgatggaaattattcaggttgggctaagctagccaattcaatgcgtttacgtgttgcaatgcgaatcagcggaacatggcctggcattgctcaagaggcagctgaagcagcagtaacacataaagcaggattgattgaaagtaattcggataatgctatgctttcttgtggcacgcagagtaatccctatcaactggcagctgtaagttggggtgatctgcgtgtgaatgcaaatattgtagattatatgaatgcatatggcgatccacgtatgccgaagttctttaataagtctacccttgccgggaaaacagataaatatgtaggtatgcgtactggagatgctgattttaaaaaggcagatgcagcaggattctctattcctgcatatacggcaacttctaaattaatggttttctgtgctgcagagacagcgtttttacgtgcagaaggaaaattgcgtggttggaatgtcggttctaaaacagcaaaagcctattacgaagatggtattaatttatcaatggaacaatatcaggtttcagccactgaatacatgaagattgacgaggctcctgtcgtatcacatgaaagtgatgttgtgcaaaatgctactgctacaattaccaatactgtgagtgtaatgtgggatgacagcgaggctgacaacgtaaatggaaagaatttccaacgtgtcattactcaaaaatggatcgccaattatccattaggattggaagcatgggctgaatatcgccgtacaggttatccggaactttatccttgtatcgacaatctatcagattgtggtgtgagcagccaacgcggtatgcgtcgtctaagtttcccttatacagaggcacaaaacaataaagccaattatgatctgggagtagcagaactaggcggtgctgataacgaagctactgacttaaagtgggctaaaaagaactaatttatataatgcataaaaaggacttttatgaagaaaatttatttattatacattgtactcatatcactggcaacgacctcattgatcggttgcagtgactggacggagtcagaagcaaaaacttttcccgaatcgatcgtatcggatgaatattatgcggccttgcgtgcctataaacagacagatcaccaagttgcatttggttggtttggtggctggagtggtgaaggtgcctatatgaaaagttctttagccggtattcctgatagtgtagatattgtttctatttggggaaattggtcgaacattacagaagctcaaaaaaaagatctggaattttgccaacaagttaaaggtactcgttttaccatgtgttttattatcagaagtgtaggcgatcaaattactccgcagaatattcgtgaaaattgggaaaatatgggattttcatccgaaaaagaagctgtgaatgatttttggggatggccttccgatgaatcaaataaggaagcaatagaagcatccattcgcaaatatgcaagcgccattgccgatacagtaaacaaatatggttacgacggctttgatatcgattatgaacctaattttggcaactccggtaatatcgtagacgaagacgatagaatgtttgcatttgttgatgaactaggcaaatatttcggtccgaaatcaggaactggtaaattattagttatcgatggcgaaccacagagcataacaggtagacctgaagtcgggttatattttgactattttatcattcaggcttacaataatagtagtcctggcagtgattctaaactcgataaacgtcttatcacaggcggcgtagcaggtgcaggacttgttcagacgtatagcagtgtcatgtctgaagaacaaatcacgaagatgaccatcatgaccgagaatttcgaggctaccgatgctgctatggacggtggatatgattacactgatcgttatggtaacaaaatgaaatctcttgaaggaatggcacgctggcaaccaagtaacggattccgtaaaggtggtgcaggaacctatcatatggaagcagagtatggaacttcaccagaatataaaaatatacgccgtgctattcaaattatgaacccgtcatcacattcattacttaaaaattaatgtaaactatgaaacgtatgaattatataaaaattttatgcttctccgcagtcataacaggcttaggaagtatagtaagttgtggagatgcaaaatacgatactttagatacacatgcttatattgaagaagctctttccagtacaagtcaaaaagtgaccgtacaggctactggagaaagttttactaccctaaatgtgcatcttagtaatctttcttctacagataatcattataaattggttacagatcaatcagtactggacacttataaccatattaatggaaccggatatataatgttgcccaaagattattatacgttgccggaaacgattactgtaaaagcaggacaatatgcagccgatgccctctccatcgctttgaaagctttcagtcaggaaatgatgaaatcgggagaatcatatgcactgcctgtaaaactagtattgcaagatggaagtatttcaccgatggaaaataccggaacctttgttattttggcagaaagtattatcgaattttcagctccaatgtttgttggcgctcctagtttaaaagctaataaattcacagaatctcccgaaacgtattcacaatatacgatagaggttcgttttcaggtagccaacacagctgaccgtgaccgtgcagtctttaaaaacggaggagatgatgcaaacttcatccttttacgttttgaggatcctcaaagtgacaatgaaaattataaggcacattcattagtacagattgtaggacgtaaccggctttatttgaatccaagtaattctttcaagccaaacgaatggcaacatttagcattggtctgtgatggttccaactatcgactttacataaacggagttgattcgggtgtgttgagtataccaacaggagcaacaactttctctgatgtaaattggttctgcttaggtgatgattcttatagtagatggggaaactgtaaaattttgatgagtgaagcacgtatttggtccgtagttcgttccgcttctcaaattcagaataacatgacgcaagttagccctaaatctgtaggtttggaagcttattggcgattcaatgaaggacaaggtaatgtgttcgaagatgcaaccggtaaaggtcatactttgacaacttctgctactcctacctggattgacggtattttatctacagataaggctactgaatggaaatagtaaaaattaaattgtatatgtatatgaaaaatatatttcaatcactatcaatagcaactctactcggcttgtttgtcccattcatttcgtcctgtagtgatgatgaagaagtttttaacgagtggaatgctacgtatgtgtctctacagagaaatgactatttatcggggaatgtaaaaaagttcaatctgactcatgatgcgaatggaatcggaggagatgaaattaagatggcttttactgtaaaaacacagaaagcagtctctacagatatggttatcgcattaagtgcaaaaagtgaaacagaagggcttgatgcaagccagatcgttttaagttcctcacaggttactctcaaagaaggacagatgacttctgaagaaatcactgcaacggtcgatccaacgatattcgccagtatcatggaaaaaacaagtttctctttcagtgtatcaatcagtaatgtaactaccaatgataagaacactgtcattagcagtaatttaagtatcttacctgtcatcattaataaagctgcctactgtaatctaaaaagtggtactcctagcaatagccaacttatcagtaatcgtgtaggttggattgttaatgtggaagaaggagtagacggcgcgcctaataatttaattgatggcagcaagactggaactgacgttgctctaaataataaaggcttctggttcaccgttgatttaggagaaactaaggttttaacaggcatcaaaacgaatcactggggaaatgcatatgctcctagagaagtggaaatattacagtctgaaaatggtatgacatggaaatcattaagttcattagcaatacccggtagtagtacacaaaacatcacgttcatctctcctattactacgcgatatctaaaatatcagattatcactatctctacaaacggtcgtacggatgttacagaatttaatgtttacgaacccaaaagtgaataaacataatgaataggtaacatagaaatgataaaatagagggtaatccaatggattaccctctattttagaaacatacttcacaaacatacttccagactatcaatctatctcccaaaagaatactccagatctctacttgttagttcatctttgtacatctttcttatgacttatggttttgaattaaatttctcctactgaatctttacgctattatccggtttcagccgtttcagttttgttcgtaaacgccttgataaagagcgacattgatatgtcgggttaaagtcgtcgacatgccgggttagtaaatcagagtctctattcgcataaaacgaaggctatgtttcactcaaacagcggctctattgaaggtaaatagagactctaaaaaagagactatttacatctcctttttgttttcaggttcgcgttcagccaaaagcaccgatgaaaaggaactttttaagtagactgaaagctgaatgcggtttttaactaattctatttagatgggctcaccacggtgaagtttgttcaaaactgcaccaaaacaaaattttcgatcaaacacttgtttctctaatgatctaagaaagccataaaggaaagggggattcttaatgagttaagaatccccctgtaaaaagacttatttatatcttatttcttcatcacccgaataatccgtccgtctttcttataagaaaaatgatttgtatgcatcaaaacattcagtatttcatcagcagtgctatcagtagagaattcaccggtaaaccgttctgatttcaaagcatcatccttatagataaatttaatatcatacaacttctccataatattggttatttccaataaagaatgttgcttgaattccaacttacctttcatccacaggagcacatccgtaggctggttatattcaatcaactctgcctgataagtatccgtattcacattcaatgtctgtcccggtttcagtaaatagccattctcttccgttcgtggagaatccacccgcaccaaaccttgaagcaaggtagtcactaccctattctcttcttcacgcgcacgcacattaaatttcgtaccaagcacacaagtcttgatttgtttactgtttacgataaatggagcatgtttatcatgggaaacctcgaaataagcttcacccgacaaatcgatttggcgatccgaactccagaaagaattatgataaactaatttagaagatgcattcagccataccctactaccatccggcagtacagtctgtgctctctgtccggcagcagttatcacctcataatctgaaagtttattggaaagtaatccccaggcaattccaccggcaaaaacaagtccggtaagaaaagcagcagacacagtagcataacgtccccaacggattgagatatttttccgtttagtctttttctccttttctctgatagccgacttaaatttatctaatgacgcctctgtatctatagcattcatcaccgctatacgttcacctacaaaaagagtataataaagttgctctatagttttccgattccccggttcttcctcgcaccaagtttccacccgggcagcttcttcatcattacattcaccctgcagataattcaacaagatagtttcatccatgctcatttaacctttttacaataaaaaaactataaaacctttgtagtaatacagttgtgagtacaaatatactaaacgaaaaaagaaaaaaatattttttctcgcatttttatttcatttatctacttctttcattatttttgtcttacataaattaaaagagaatgccacaatctccgatatatttggatattaataataataagtccgtcatcactgccttaaaagcaggagaggaaaaagtttttgacgtcgtctacagacattatttccgtaggctatgtgctttttgttctcaatacgtaagtgagcaggaagaaatagaggagattgtgcaggaaacaatgatgtggctgtgggaaaaccgttgtactctgatggaagatctgacactcaaaactcttctttttacgattgtcaagaacaaagccctcaaccgtctttcccattttgagattaaacgaaaagtacatcaggaaatcgtagataaatatgatagtgagctcaataacccggacttctatttgagtgatgagcttttccgtctatatgaagaagcattaaaaagacttccgaaagaatatctcgaagcctacgagatgaaccgtaatcaacatctgacgcataaagaaattgccgagaaactgaatgtatctccacaaacgattaattacagaattggacaagctttaaagctattacgagtagctttaaaagactatctacctttattcatacttattttcggacctaattttttcgaacaatcatgaaatcaaacttcgtatttagtagttcaagcctgtttatcggactttttcttttcttcttcacagaaaatgtatgttcacaagaatctgctgacaactggactcttaaacaagcccgccaatggacacagaagcaagaatgggcgaacgggctgaaggcaatgcctcataagacaaccgattatcaggagtttgcctcacaatatcacaagaacaagaaagtgtgggacaagactttccaatggctagctacccacgacctcgtaaatatgcctgccggacgatacgaagtagatggtgaacattgctacatcaatgtgcaggatgcaacaacacaagatgtcagtaaacgtaaaattgaagcacaccgccacggcatcgatttgcaatatgtagtaaaaggtaccgaacgtttcggaattacttcagccgaatatgcggagcctatcaccgaatataaaccggatgttactttctacaaagccaaaaaaataaaatatgtagattccactccggacacattcttcatgttcttccctaaaaacttccatcaggcattagtaaaagccgggaaagaaccggaagagatacgagtaatcgttgctaaaatcgaatatatcccttaaacaaaaacatgagtgaacttttagtctataaagcctctgcaggttcgggtaaaacatttaccctggccgtggaatacatcaaactattaattttcaatccccgtgcctaccggcaaattctcgctgtaacctttaccaataaggcaacagcagaaatgaaggaacgtattcttagtcagctttacggcatacagataggtgataaagattcggaagcctatctcaaccgtatcaaagaagagacaggaaaaacagagcaggagatacgggaagcggcaggcattgcccttagctatatgctgcatgattacagccggttcagggtagagactatcgactcatttttccaatctgtcatgcgtaacctcgcacgggagctggaacttagtccgaacctgaatatcgagttaaacaacaccgaagttcttagtgacgccgtagatagcatgatcgagaaactaggtcccacttcccctgtcctcgcatggttattagactatatcaatgagcgaattgccgatgataaacgttggaatgtatcagacgaagttaaaagttttggacgcaatattttcgatgaaggctatattgaaaaaggagaaggacttcggcaacgactgcgtaatccgaacaccatcaaagaataccgcaaacaactgaaagctctggaaacggaaatactggagcaaatgaaaggattctacgaccaattcgaaggagaactagatggtcacgcattaactgctgatgaactgaaaaacggttcacgcggaatcggaagttatttccgtaaactgaataatggcgttttaagcaatgatatccgtaatgccacagtagagaaatgtctggaagatgccaaaaattgggcaaccaagacttctccccgttatgcggatatcatcaacctggctaattccagccttatacaaattctggaagatgctgaaaagttgcgttccaagaataatttgttactgaatagttgccggttatccttgcaacatctcaataaagtgcaacttctcgccaatatcgacgaagaagtacgtcagttgaaccacgacaacaaccgttttctgttgtcagacacgaacgccctgcttcaccaactggtgaaagacggtgactcctcttttgtattcgaaaagatagggacaaatatccataatgtcatgatagacgagtttcaggataccagccgaatgcaatggggcaacttcaaactgcttttgctcgaagggctgtctcaaggagcagacagtttgattgtaggagacgtcaaacagtccatttatcgttggcggaatggtgattggggaattctcaacagcctgaatgaccacatcgagcatttcccgatccgcgtcaagacgttagccaccaatcggagaagtgaaacgaatgtcatccggtttaacaatcgaatcttcacagctgctgccaactatctgaacggagtgtataaacagcaattaggcaaagattgtgaggatttgcaaaaagcctatgccgacgttgtgcaggaatctccccgaagtacagaaaaaggatatgtaaaagtctcttttctcgaacccgacgaagaacatgattataccgaacagacattaattagcttgggagaagaagtgcaacatctcctcacctccggagtacaactgaatgatatagccatcctggtacgaaaaaataaaagcattcctcgaatcgccgactacttcgataaggagctacactataaagtggtatcagacgaagccttccgccttgacgcctctcttgccatttgtatgatgttggatgcactgcgattcctttccgatgaaaataataaaatagcacgtgcccaactggccgtagcctatcaaaacgaggttttacagaaaggactggattggaatactctcctactcctccctgccgagaattatcttcccgccgcttttcttgaaaagacaaaggaactaaggttaatgcctctctatgagcttttagaagaacttttcagcatattcgagatgaatcttatcaaagatcaggatgcttatttattcgctttctttgatgcggtgatcgattatctgcaaagcaactcttccgagctagacggattcatccggtattgggacgaaacattatgcagtaaaacaattccgagtggagaagtagaaggtatccggattttctccatacacaaatccaaaggattggaattccataccgtactccttcctttctgcgactggaaactggagaatgaaaccaataatcagcttgtatggtgtgccccgcaaacagcaccattcaatacattggatattcttcctattaactattccacccaaatggctgaatcgatttatggtaacgactacctgcaagaacgtcttcaactttgggtagataatctcaatctactatacgttgcttttacccgcgctggaaaaaatctcattatctggagtagaaaaagtcaaaaaggtaccatgtccgaactattggcaaacaccctaccgatagtagcccaagaagaagggattgactgggaagaagactgttatgagcaaggacaactatgcccttccgaaaaagaaagaatcaagacatccacaaacaagctaacccagaaaccagagaaactccctattcggatggaatccatgcggcatgatattgaatttcgtcagtccaaccgctctgctgacttcattcagggcattgaagaagaagattcggacgaccgctttatcaaccgcggacgtatgttacatactttattttctgtcatcgaaactgcagaagatatcgatccagccatcgaacggcttatttttgaaggagttatcagaaatgacgagaaagaaaaagtggctcgtgaagttgcaaagaaagctttttcttctcctgaaattcaagattggtattccggaaaatggacactgtttaatgaatgtgctattatctataaagaaaaaggaattttgcaaacccgtcgtccggatcgtgtaatgatgaaagacgatcaggttgttgtagtcgatttcaagtttggtaaggaaaatcctaaatataacaaacaagtgaaaggatatatgcaacttcttaccaagatgggatataagaatatcaccggctacttgtggtatgtggatgaagaaaaaatagaaaaagtatgaaagctgttcctctcatcggcattgcccgccatcgactaacgattgacggtgaaggagttacaacattagttgctttccatggctgtccgttgcgttgcaaatattgtctcaatccaacttctctacagcctgatggcgtttgggagagatacgattgtaaccaactctatgaggaagtacgcaaagacgaactttactttctggcgagctgcggaggagtcacatttggaggtggagaaccattattacaaagcgaatttatcaggcaattccgccaactctgcggaccggaatggagaatcactgtcgaaacctctctcaatgttccgcaacagaatgtagaagaactgatttctattatagacaattacataatcgacatcaaagatatgaataataacatctatcagcgatataccggaaagaataatgaaaacgtcttaggtaatttgcgatatttaatcgggaaagacaaagccaagcaaatcgttattcggacaccactcatcccttcctataatacggagaaggatattgaccaaagcatagaacttttgaaagaaatgggaatcacccaattcgaccgattcacctataaaacccctaatgattaatgccatggcaagaggaaaacaaacctgtaaaatcttaaaagagattcgtcggcagatagccgaagcgaatgatattgaattcatcacctctgaatgtcagtatcagggagattgtttgggtacttgccccaaatgcgaagctgaagttcgatatttggagcaacaacttgaacgaaaacgccgtgtaggtaaggccatcgctctgtttggactatcaactggtatacttacaataatacctcctacttcattggacgcagaaacactgcaatgccctaaaatgaattggaccattactgctgacagcctgatacaagaaaaagacatgaaaggggaagcccccttttatggtccggaaaagctaccggaatttcccggaggaacagaaaaatttatagaatttctgaaagaaaatcttcgttattcagaaatagatagtattgctaataatacatacactgatgtaaaattcactatagattatgacggacaagttatcaaccctaagattacccgcaagatacaccccaaagttgaagctgaaatattaagggtcatgtctctcattcctcgttggacacccggcatgttggcaaatgagacagtacaagtgacatacaatctgatgctttcattcagtgcgatgtatggcccggaattgagaatcacttatactcgtataaactatcctgacgtttacgagaaagtacctgttatgcccgattttcctgaaggccagcaagctctcatggaatttcttgcaaaaaagattcaataccctaatacaggaacagaaggtaatggtgtacaggggcgtactattattcagttcatcgttgataaagaaggaaatatagtcaaaccaaaagttttacgtggcgtagatccttatctggataaagaagctttacgcgtcattaatcaaatgcctaaatggaaaccgggagaactggaagatggtactaaagttgctgtttatttcaccgtacctgttatgttccgattacaataaatacaagaatcagaaaatagtttaatcaatatgcaatcatttctccaactagtcgctcatgatttatataccaagataggaaacgacctgtcacgtacggtactcgttttccctaataaacgtgctaacttgttcttcaatgaatatttagcaggagaatccgataaaccgatctggtcaccagctgccatgagtatcagcgacctgtttcagaaactatccgtacagaaaagcggcgatcctattcgattggtctgcgaactttataaagtgttcaaagaggaaacacggagtcaggaaacattggacgatttctacttctggggcgaattgttgattagtgattttgatgatgtagataagaatatggtcgatgccgacaaattattcagcaatctacaagatttgaaaaatctgatggatgactatgaattccttgacaaagagcaggaagaagccatacaacagttttttcagaatttctccattgaaaaacggaccgaactaaaagaaaaatttatttccctttgggacaagctaggtactatctaccatcgttaccgtgcgaacctgacagagttaggcattgcttacgaaggcatgctctaccggaacgtgatcgaacaactcgataccgaccaactcaaatacgacaaatacatatttgtcgggttcaacgttttgaacaaagtagaaagtgactttttcagaaaactgaaagatgcgggcaaggcactcttctattgggactatgatatcttctacacccaacaaatcaaaaaacatgaggccggagaattcctgaaacgtaatctcgaggaatttccgaacgaactcccggaaagctttttcaacacctttaaagaaccgaagaaaatacgttatatttccgcttctaccgagaatgcccaagcacgtttccttcccggatggattaaggcgataacaaacgatcattcacaaattaccgtagaaaaggaaaaagaaaatgctgtagtgctttgtaatgaagctctgttgcttcccgtacttcattccattccgcaggaagtgaagaatgtcaatatcaccatgggattcccattggctcaaactcctgtttatagctttatcaatgccgtaatggaactgcaaaccaatggttaccactccgataccggccgattcacttacgaggcagtatccgccatattgaagcatccctatacccagcaattatcatcccatgccggtcccctggaacgtgaactgacccaaacaaaccgtttttatccacttccgtcagaacttaaacaggatgattttctaactaccctcttcactccccgtaatggtataaaagaactatgcgattatctgatcgaattaatcaaaaacatttcaaccatttatcggaaagaaggagaatacaatgatatcttcaatcaactatatagagaatcgctctttcaaagccataccaaaatcaaccgtctctacagtttgattgaaagcggagaactaaatatacgcaccgatactctgaaacgactgattaccaaagtactgacatcttctaacattcctttccacggagaacctgctatcggaatgcaagtcatgggagtattggaaacacgtaatctggacttccggaatctcattatattgtctctcaacgaaggacaacttccaaaatccggaggagattcctcttttattccctataatctccggaaagcatttggcatgaccactatcgaacacaaaaatgcagtgtatgcctactacttttatcgactgatacaacgggcagagaatatcacgctactctacaatacttcttcggacggtctcaaccgtggagaagaatcccgcttcatgctgcaattacttgtagaaggtccacatgatatcactcgcgagtatctggaagccggacaatctccgcaaagtacccaagagatacgagtagaaaaaacacctgaagtactaagacgaatctatcgtgcttacgatagcactcatccaaattcactggttctctctccttccgcccttaatgcttatctggattgccggttgagattctactaccgctatgtagcgggcttgaaaacaccggacgaagtgagtgctgaaattgattccgctctattcggaaccattttccacctctccgcccaattggcatacaccgacctgactgcaaccggaaaaacgatacagaaagaagatcttgaacgcttattacgcaatgacgtgaagctacaaagctacgttgaccaagccttcaaaaaagaattattcaaagtttctcccgaagaaaaaccggaatataacggcatacaacttatcaactccaaagtaattgtttcctatctgaaacaattgctgcgtaacgaccttcaatatactcctttcgaaatggtcgctatggaaaagaaagtttcagaagagattactatacaaacaggacaaggaccgttcactctccgtctgggtggcacaatcgaccgtatggatgcaaaagaaagtaccctgcggattgttgactacaaaacaggaggaagccctaaaatacctgctaatatcgagcaactgtttaccccatcggaaacacgcccgaactatatcttccagacttttctgtatgctgctatcatgagccggcaacaatcgttaatggtagctcctgctctgctctacatccaccgggcagcatcggaaaactattcgcctgttattgaaatgggagaacctcgtaaaccgaaaataccggtaaacaacttcgctttctttgaagatgaattccgtgaacgcctgcaaacattattagaagaaatattcagcgaagaagagccttttacgcagacagaagatactaaaaaatgttcgtattgcgattttaaggctatctgcaaacgataaaccgaaaatagaatataccaattaaataagggcacgatttacatattcatgcaaaccgtgcccttattatttctagtcgtattatctatagttatcttatttctccaacaatggaattgagaaactaaatgtagacccgtctcccttctttgaagtaaaccaaagtttaccgccatttttgacaacaaagtcctgacacaataacaatccgagtcccgaaccttcttcattgtttgtaccaaaggtactgaaatgagtatcggtatgcagcaacttcttctgattttcgtcatcaataccgcaaccactgtctttcacacttacgattgccataccgtcttcttctgccagtgacaccactacttccgaaccttcattgctaaacttaatcgcattactgattaaattacgaatcaccgtcttaatcatgtcaatatcagcacgaacagccacattctctacaggcacatcttgtactatcttaatatttttcagactggtcaccatcgtaaagatttcacttacgccctctacgacttccaccatattaatatcctgataaaccactttcagtttaccaatctggctcttcgtccatttcagcagattatcaagcaatgagaatacatcttctgttgtctgattagccattgtcagcaattcatacatctcatcaccaattgtttcgcttggcagattcagaatcagcatattcagcaccatcttgatagatcccattggtgaacgcaagtcatgtgcaatcacagaatagagtttgtcgcgtcccatgatcgtcttacgcaactcttccgtttgtgcaacaatgattcttttcgctgcaaccaacgaaatctggtgcgtcacacgaataatcaattcttctttattgaatggctttgaaataaagtcattaccacccacctgaaatccttttacgatatccgccgtactatttagagcagtcaggaagataatgggaatttcagccatttcggggtctgctttcatttgttgagctacctcaaagccactgatatccggcatcattacatccagtaatacaagatccggattttccttcttcacttgttccaacgcctgtgttccattaccggcagtcacaattttgaatttctcgttggtcaaaagtacctttaataaaaggacgtttgatattacatcgtccacaataaggactttatattcagaaggattaatttccatattcataattttctttttttatgcttcagacatttttaaaatattcaatcatacgcttcagcccctcttcaagttcaacagtaggctgccagcccaatttctctttagccaatgtaatatccggttggcgttgcttcggatcatcatccggtaaagacttaaatacaatcttcgaagatgaaccggtcatactaatgatcctttccgccaattccaataccggaaattcattcggattccccaggtttataggacctgtaaactcgtcctccgtattcatcattcttatcattccttcaatcaaatcatcaatatactggaagctgcgtgtctgcttcccatcaccatatattgttatatcttcattattcaacgcttgaagaataaaattagaaacaacccgtccgtcattcggcaacattcgcggaccatacgtattaaaaatacggataatcttcacacgcacattgttctgacggtgataatccataaataatgtttctgcgcaacgctttccctcatcatagcaagaccggtaacctaccggattcacatttccccaatagctttccggttgcggatgaacgattggatctccatatacctcactcgtagaagcttgcagaatcttggcatccagtctcattgccaatcccagcatattaatggctcccatcacagatgttttggcagtttgaatcgggtcatgttgataatgaatgggagatgccggacaggccaaattatagatttcatctacttcagccgaataaggataagtgacatcatgcctcaccacctcaaaatgatgattatccatcaagtgaatgatattatctttcgaacccgtaaaaaaattatccaggcatatcacgtcgtgaccttcgtttataagccgtgtacagagatgagagcctataaaaccggctccgccacttaccaatattcttttcattctaaatatttctattgtttactaaagagacgctgtctcttcgttttgtttatggtcacaaatgtaaccgatttgcttaaaataaacaattttcggagaggatattttaaaaaaaagaagatttaaatagtttcaatttccgaaacaacttgccactgacaaatgtttataataaaaaagtattatttattagaactattatgatgacaaataatccaaatgcaaacctcatagaagcgatgaaggaaaagttcccgctcaaagggcaactggcagatatgttaatggacacgctatacataggaaaagaggcagtatatagaagattgcgcggtgaagtacctttcaccttgcaagagtcggctcttatttcaagaaaactgggtatatcgctagacaagattataggactaagtttcaaatcgaacgccatgttcaatataaacattgtagattatgacgacccgttcgagagttactacaatatccttgaaaaatatgtctcgctgatcaatacgatgccggatgacccgaattctgtaatgggaacttctgccaacattattccccagactctctatctgaaacatgagcttctggcaaaattccgtttattcaaatggatgtaccagaataaatatattgattgcaagagcttcgaagagttggatattccatcgaaattggtcaatatccaaaaagactatgtagcaatgacacgtcatatccactccatagactacatatgggataatatgattttccagcatctcatcaacgatatccaatacttcgccagcatccatctcatttccgacgaaacaaaagaagaaatcaaaaaagaattattcttattggcggatgaactggaagaactggctatcaacggtaaaacagccggcggcaatcgtgtacgcatttatgtgtcgaatatcaacttcgaggcaacatatagttatgtagacatcaataacctgcaactgagcctcatacgtatttattctatcaactccattaccacgatggacaacgaaattttctgtaccttgaaagaatggattcaatctctgaaaaagttctccactttgatatccgaaagcggcgaaatgcagcgtattcaattcttcaagcaacagcgagaaattattgacgctctttaattttattttcgcagattagaacttcaaaaaaaattaagttccaataaatgaaagtagataagaatcttatctactttttttcattccctgttcccatcctacccacttgattcccaatcagaaaaagacctgcacattcatctctgttttaccacacaaatctttcaaacacaagacgtaattttgcatagaatgtatcacagagattattaacattaaaattaaaggaacaaacaatgaaaaacggtattctaaacgaattaatatctacaatgagggagcgaattcctcaagatatgaatctggccaatactttggctgacattttatgcatgggaaaggaagctgtctatcgcagattgaggggtgaggtgtcttttacaatagacgaagtagcgctgctttctcaaaaactcggcatttctatcgaccagattgtcggtagccatgtatctaataaagttactttcgacctgaacttgcttcatgcttccagtgcgctggaaagttattacgaaataatcaaccgttatctgcaaattttcgactatgtgaaaacagataatacgacggaggtgtatactgcatccaattccctgccctttacactttattcttcctatgagaatttgtctaaattccgtctttgccgatggatgtatcagaatggagatataaagacgccacattctttggaagagatgtctgtggatgaacggatcgtcaatgtgcataagaagctgagtgaaagtataagacagtgtccaaaaacgtttttcatctgggacacaaatatcttttattcttttgtgaaagagatcaagtactttgccagtctgaatctgataagcaaggacgatgtcatgcatttaaaggaagagcttcttcagttacttggcgtggtagaacatctgtccataaaaggagagttcagcgaaaacaagaaagtatctttctatctgtccaatatcagtttcgaagccacttacagttatatcgagaaacatgattaccaagtcagcctgctgcgggtatattctatcaattcgatggattcgcaaagctcgtatatctgccagatgcaacgcaattggattcaatcgctgaaacgccactctattctggtttcagaaagtggagaagcacagcgtatcgcttttttacaaaagcaattggaagttatcaatacgttgtaaacaattgtagattttaggatataaaagaaagagatgtaaaagacgagctgtatcagaatgaagacaaacaagattctgatacagctcttttcttttagcttttattctattgtgcgcacacaacgataccaagcccaatctgtggattctccagtagtccatgcgccgaattcaccattattatgtccgaccacccaatagccgccatcgcgtgaagtcaatgtccaatgtacagcgctaatcttctcgaatccgctccctgtccaagtagtcgaaccaccgaaaccttggttttcaatgctggtaacggcccctcccatactgagcaccagatacatctcacgctgggtaggcagacgccagccactccctttgttttcgcatgccgcttttgcttccgaccaagttttaccattactactggtattttcaatctgaaacttaggagcaatcttattcatcgcgtcacttgtacccggagtttcacctgaagcaaataataccgaaggatccgttcctccactggcatcacgagagacaatagtgacccccgaggattctaccgttagataagggtacttctttccactatttgtattattcctcacgcaacggaaataattattcttgctaacagattcggaatccaaaaaacctgccgacatctccatccaaaaacgggtagcagagcctttagcctcatagtatgatgaagtccagtaattaccggtccagttttgataccacccatatatattctggctatcatgattattataattctctgcattgccacccaaagcattttcataagcgaatgacagcaacagttcactggcagtaggcagacgccaaccatcgcctatattcctacagatatcctccgcatcggctacattttccaaccgtcccacactttgcttcgtctcgcctatttccttataatatagcctgttatcaaaccgaagtggataaagatagaaaagaggttcccctgcagttgtgtaagatttggtttcggataccatctgaaggtcaatcgtacgataaaacgggaattcttcatccgacacagtatgcattacatttctgaacgtgattcttatcgttccactttttccctctttccacttgccagggtgaagcttcagcctaaaatcgtatccgtggccaaccacatcattaccctttccgtcatcatagcctatgatagactcaagatacatcttgtcgtccgcattctttctgcctataattacatcattatccgaatcggtccgaatcagtccggtaccatcatcgttcgttatattcaattcctcaatatccataatttcccaattgttattgacaaacaattgcaagtattgctccgcacccagattgactttataagtacggctattgactgtagtgggaatatatcggaatgagaattccaactccccttgattgatggggaattgtacatgagtgaggtatccctccttatcgtacaggccgaataagatgaaatcccaacgccaccaccaaccttcaccatcttcaacagtaccatcacctgctcttcgcggattaggctgtatggtaaacgcctgcaccctttcactgaatggtaccgtattcgtcctgtctaattgcggaattaaaccgccggcattgtattggatcataccgatatcgttagcgtcaaaaagtttaccttctatcttatccacggaaaacatgacatacaccgtctgcggttcaagagggagttcgtcaccatcgggatttctaatcgggaaaaaaagacctctctccaacacatttccgtatgcatcgacaaatttgataattcccggatctatcgtatactgcgtcacttcaatattgtgagtcaagcgccctgctgtcaacgtaacagtagccttacgctcaacacctatagtttcattattaaaataaggaatcttcaatttgagttgggtatcatcgttcgcaacgcccgacgccgcatcgactccaccttcaaatttgagccagtcgctccctgcagtaacggtggccttccaaccgccgggattgtcagtaaaaacgtctatggcataactattattctggtattgagttacagcgacctccgattcacccactccgagcatatattgcccattgtagactacatctttgaccttatcacggtcatagtgtatcaatcggaatttaaggttggacatgactgtataagatgccaacgcctcgctaaaacttttataaccgattcccaacgccttagtaatggtaatgatgtatttatggtttcgcttcaaggacaaatattccacctgctctcctgtatttccggttttggtaaaatccacccggtaaaatgtcgattcgcccgtaccgattcttcctttcacaatcaggcaagtagcattcttacggctcgcttctccatcttgtcccacaccaccggcatcctctgctgctagagattcaaatgtataaatctccccatcgtagggtgtgttgccatttacggagtaaagaattgcatccccttcttccgtcattttaccactgttcacagggagaaccggagtatccggagccgggtcagtaacctgcccgttcgtgttccatgccggagcaatgtatccggtggtattgtaattagccaggtaaacctcttcgaccgtgaaattcgaagtggcactgttattacggatatcgatgcgcgccagcatacgtttcatatttatgccagttatcggatccatcgaaggagtgattttgcttattaccttctccccgtacatcggaatccgcgtatacccatcagtcgtcgaaccgtctgccagccatttgccggtctgggcgtggagcatcttttccattgcctcaaccttggtggtcgttcccttcatgaagcccgacacaatattatcaagttccttatttgccacaaccacgatgcaagtagatgcggtagtgggagaaagcacagcagagaaactcacagtggaattgtcagccaagtcctgagtaactcctgtagcgctgacgcattccaggtataccgccggtgtttttgacatatcaaaaacaagaatatccaccgtttttatttcgtcttctttctttgcagttcccgctccggtcatcgtacgcgaagatacggacgggaggtttacatcgggaaccgttaatgtaaaccggataccgtttcctgccggagaaggtgtcgatcctaattcttcctgtacgcatccggtaagccataccgtcatcaacaaaacagacaaaagatagcaccttcttatgattgaaatcccatattgcatatttctatttcctttccttaaactttaatattacatattcgccattatggcgcagtcaatgtcaccgctattggcagattatcaccattcgtattggttagtgtgagtgtagccgtatcaccggacacagcatcggctctaaagtagaagtaaaccacatcaccactcacgccacttgtttcgagcattgtctcactgttaagcagaattttatccggatcctgtatctgggttatcttccactcccacgttcccgggttgcccgaagtaaagacaagcttgcgacgttgcatatttccggttccaccatcactgccgtccaattctacgttcgaggtcaaccactctccgtcttctttccactggctcaacagtacatgatgccgcagattaccggcattgatataaaagcctgtttcccgcttagttccggttccggagttaaatccgggcatcacaacctggatattataggtatacacacctcccgaaagggatgtctgagtcatattaaccgttgcccacgtatccatagtacttttgtttaatgacgcacccggcagatagcccgtattcggattggcatcataattcgttttcgcttctatattgacagtgacaccatcaccagccgtctgtaccttggtctgcgataatttgagataatattgtttgtcgaaaatcacattcaccgggctttccgtccattcaagcggcgtggctgaaagctgataggtttcgttggatatcgtaagattatagttgatgtactcgcctgactcccaagaatgcgggttcttggcaataatatcactgaagaggaattcccggtcgccaaagttggtggtaacaacgattttggcggttgcggagaaagcgtcggtcggcaacatgaggaatgtatcccccatcaaggtggcatcttcggtcaccgttttgttatcggtgagagtagaaacgaccttcccggtggcaacatcgctccagacaaacttcggtttgccgtttttcgtcgtggtagtcggaatttcagtcatggcaagtttaccgctttttcccacattctggaattctattttctcgatagtcacctcatccggcacaggagctacttttttgaatgtaaaggtaaccttagtcaatgtgtggtagaagtgtatattcacaccctcaatccatacaggacctgatatagccgctagtacatcgacatgattagcagcggattcattcgctgtataattcagcaccattttttcgggatcagtgaaactcgcagtaggcgcattcgcatcgttgtacggataccaagagaagaatttcatgctcgcattcagcaatccgggccaatattgcaacggcgagatggtggctgttaggtcggcgttaaccgtggcacttgcattgaagtatggttggggaacggaagcattgggagtcagtgagccgtaaagaccgaaagtctcttctttcagatcggtattcgaagagattgccgcaccacgagtgtagacatagccgccttctccgatacgttgcacaacaattaattccttatcacacgtcatctcttctctgacacacgaaaagaggacagccgaaaggacagccattgccataatcatcctaatattattaatagtctttatcatcttacttcttttccgaaattaaaaacaatcaacgaaagatattacaagcccagatccaagtcaatgtcttgtctttcaccccaatcttccacgcttatcgtcagtatctgaatacctatttttccgacgcgtgccgttacctgatacacgttgttccgacggatctccgtaaaaggttgcgccgtcggactgcctgtgtcgtcaacctttgttacgctttcaattactttctcggttattccagtgacgtccgaaggtcctttcgggacattagccatactgatagacagtcggtcggaataatccgacttgaataggcgttcggctgtatagaacgagcaaagcaacttccggttttcagctccggcagccgatgaatatgcccaggtttctgtagtcgtagccgtccagctatgcgttaacaaattgctttccgacacgtcttccttcacttttccgtagttttttgaagagtcggcgttatcacgcgtaccgttatccacgtttcccatcacgaaatagctatcgtgagagaaattgtgcaaggtgacactggtgcttccggcaatatatccggtcaccgccccgccgtctatagcttcgataaagacatctactctggctacggcacgttcgatcaccatttgtactgttttggtttcatcgggtgctatggatatatcccggatcacccctgtcataggcattccagtcgtcgaaatgatctgcccgtcattattcagtatgctggagatatcgtaaatcatctcctgcaatgtcaaaagattggctataccgtcaagtttgcttgtgaggctctgcggttcgttggcaataactacgaccaggatatcattgctggaagtcacttcgagaagttgcgcatctatatcagtagctgtctccggagtactcaacaagatgtgttcattcacatccagcctcacgccaccgggcgtgctgccgaatacgataaaccgcatggagtttatcttctcctgttgttccacatccccattgttcaccaagtcgatgctaagttgcgcccgggtagtatgggcaggcaactcataagccacatcagcttctctactacatgagaacaaaaggatggtggatgccagacaaatgatatgtaatagcttttttctcattcttaaacttccatcccgtggagccaatgaatccagttccccacgacaataccaatttgaaggaatcctcctccgtttttttcaacaactgtaaatatcaggttccattcactctgcctgtcaagatattcctgaaagggaagctccgttccgtcgtaacgggaaaccggccgtgcaatactcaagagtgtcatcagattatagctccagacttcagcttcggtattcgcatcccttataataaatttataatcccatccactcctgttgagcaaacgcatcgtgttcaggcgtgcggacataaccacgtcggatatttcacccggacctgtatagtaaggcacataagtaaccggcccttgtcctgcgggttcgttttcccaggaataaactgcattttccggcgcctgaatttcaaatgtatattgtgtgccatccactttattttcctcatatcccattaacgcgagattaaaccgattggtgtcacgtatcaggttcaccggataaattttatggtcggtactggatggcaggtggtccacttctacaacctctccgaagtaaagatgctgaaactcgaaattaacaacatccgtctctcgcttcagggatacaatgacctgttggagggtgctagttcccggtgccagtttattacctgcattgtccgaaagacggaatctgtcagacagacttccgacggtcagtactttataacttccgaaatcgagctcgtcggtcaacgacatccggtttccacccaccagcgcagcaacctcggcacttttggtgaaaagcaatttatcatcgctgtcgaacacaagtacatccaccgatttaacctgcggattaaatgcatccgcatattccatattgtagtcgaatacaaattccaaccaaagctcgcaccgtggaaggtcttcgcgtatactgtcgcacgaagccatacatagcatcgaagcaacgataaggaacagcgatttagtttttccgaacatatctttttcttttaggaggcaaccctatcggtttgccattttatattgtcagagatctctattttgtgacctccggttatttcctcttttaggggcgcgctttgcatttcattgcatctcggatgcgccggtatatttcagtgctgtttttgggaagcctgtcaccggcttgtttttacttttttcggcggtctgttccgcacagaatatctattaaaaaaagtacagggcaggcagtccgcactgccctgttttctttgaaagtaaagaggttctttagatttcgaaatttgtagtccagtatatccacggagcaactttaatctcaaagtggagataagcacctttcttatcgatatcttcttcttcatccggatcttcgggtccaccaccaggataccacggtgtaccgttaccatttacctttgtcagcgtaagcgtataatagttattacgtactacaccgtattttccatactccatataagagttggctgcattgtcatgacgaatctcatagtagtaatagttgagactctttggataccaatagatgcaaccttcttttttacacagttcaccaccattcttaatgttgttgtcatcaagaatagtctgtgtaagaagagcaaaactacccggatcattggtggtaagttcagattgtatctgagtatagaacagttcgcatgctgtaaccaagagtttctcctgggcggtcatagggtctgagtttgtttgtttagctttagcaggtgtataagcagccagcaagtcagcaaaacttttgaagtttacagagttagttccgttaggaagacgataccagtcatctcccaaagtaaattcaccggacttccaaggtgcatactgtcccttaagtaccagacgcgtagccgcaccgaacttctgatatccttcagccatcgtattctcgatacagtatttataattatcacccgcatctgcactttcagcaacccactctaccttaggttcgcggttagcatcaagtgtattcttaacaatgcctgtaagatattcagttccacctgcagtcgtaaagttcgggtcaactgtatagaagttacttttgtagaatccggtagtatgagatgacgctgtggtagtcttctttgcaaaaggatagaacagagagttatagtagtctatagtccagtttccaaaatcaaattgtccaagacttgcatttgttccatcttcaaaaggtccaactgctaatggactgccaatcataacttccaactttgcagcaaggcgttctatctcaagagtagccggattacttttcgctgcattctgagcttgcgcttccgatttatagtcactgaccaaaacaatcttgtccgatacatcgagcagacattcatctttccatgcatgattggatggatccgaatcggaatcatcgtagaatccgacattaatcattgcacaaccattggagtgtacaacctcctctaccagataagcattgttgggcttagtattgttttcaggaactgtaaccattgcattgatggtagcataggttgcaccctctgaaaggttatccaagcgatcctttaattggtaacccggattggctataacaagcaaatacttagtattcggatccactttaaccggagtattcggagtcgtaactccactatttgttccgaaagaacctgatcccaataccgtggcatacttagttgccttttcatccttagtcaccaccttacccgcatcgaacgtaatcacataaagctcattaatcgcgctttctgcaggcaaagccggctgttcaccagaagcacgtgaaccaggcacttttggattagtcagactaattgatacgtaagctacatcataacctgctcccccttcaacctccggattttcctccagattctcatttgaacaacttgctaatgccacaacggccagcaacgaaactaaaattgatttaatctttagcataatacaaaaaattattagaattaatacatatataatttcccacttaattagtaagttttacttaccattttttctcatctcggcagcattagccttcttcctgactaattcttccagattgcccctagctgcatccagacctaactgctctgcgaccttcaaatacttcttcgataattcataatctcccttcattaacattaatattcccatagcattattatattccggcaaattcttattcgaattcaccatacccagataacgttcggccgaaaccaagtcattgcgtgataaagcggcagtagcagcatttatatttgcaatctcactctgcggatacatccgtacagccgtttcgaacacatcaataaactcttgcgagcctgtcggataggtattagccaccagaaacatttcattcaagctcaaattctgcggacgcgtcttgataatctctttcgcttcctccacactaaaattcctcacttcgtaattcactttgcagatagccacacgcaaacttggaaaaatatacttcaacaagtatcggtaaggtgttcctccgtgaagttgcatcagttttgtttctcttcctttttcaataggtatattcctgataatatccagcacttcgtctttatattccaattcgattgtttcaagcgccttctccagtccgtcccagttttcacctccaaagacaatgtagtattggtttctcggaaaatcgtatctgtgtgccagataatcccgaagcgccatggcacgcccttcagacagacgtttgttcgctgccaatgttccttccggagaagcataaccgataatatccagacggttcactttcacattcggatcggacttcagctcatcgatcatcttgcggattttagctagttcctgagggttattcatgtattcgggacgaatattgactttattcacctcgaaatccagaaaacattctgcttgaatatcccgttgtttgatttcttccactttcggttgcagataagcaaactgaggaaccgctacgtaaggcgtccatacacgttccaacgtcactttgccaaactcctctatgttcatcaatgccgtttcgccgcaaccacattcatcacgctgcacgtccaagcgcgcatccttcatccatgattcgaacggaaccagatattgataccgaatcgtatcatttcttagttttccagctttttccactatatatggcttctcgtagtttcttttctctttggcgctcatcaacgcaagctcacgctcatacgccagatactcgtcacgacctttaatagaaactttcggaagattctgagtacgtccgggagtcaccagccgcggaataaaatccattccccgggcagatttcactttcacattattcaaaacaaaatctatatcgacatgaataaaatcacctttctgttccaaccgcaccggattcacagtaatgacaccttcgtaagagcgggattgagccatagctgtgtttatattcaggctgcaaaccaccaacatacacacaaggaaacctatttttcttattatcatactcctcattatttaattacataaataagtgacacactcgctttagtaggcccgaaatagtttttgctgctttcctttagtctcgtaccacaagtagcgcaaggatacttgtcatatacaatgtgcgcatatcccactccgacagatgtttctatactccagcgttttttcagaatccacgaatatcctacggaaaagccaccaccataaagatatccttgataacgcgtatgctgcatattgtcactgataaaagaccagtcgggccatccccctacattgaaatcggcataatgtccatgcattccgacaaacatacggcgaaaactctcacaaaaccagtaacggacttcaggttgtattccccaatgacggaggcgtttgccgtcggaaagtttccacggattataattgaccggaatatccagcgtccatttacgcgccagtccgatctccagtcccagattcatggtagtagtagcgtcatatagcagattgcttttcagcgcaaccttctgggcatgcccctcggaaatggcacatccgagcatgaataatatgagtatagcaactttcttcatttatatcacatttactgttgtttattgccccaattgagtaacatctatttttatgcgttgcacattactgatgcccgttttaacggaagacaccattgttgtgagatgtacgattccgtttctggaatccgcctctacattgggcaataccttaatatagatcttaccgtcttcaacgataatgcgttcttctcctgtatgtccctccggcattacggaagaatacagacgaatccaatttttagcactttcatccacttcgcccgtaaggcagaaataatcgatttcatacacctccgaatttaaatttccagtaggcatgagctgaagtgtacttcccgtagcaggaacagcttccctttgtctaatatgaacttctttttccaaatttcctgtttttaatgttataaattcatggggatagtttcttgagtgtcactataagacagagagccaagcaaaggattgctcaacggcttagtcaacaacctggcatatatatccgcacaagttgtcaccttcgatgttaattgaaagagagtgccggtcacattcgacccctgcacacacatcacagataataaaaaaatcaaatataaaatactgattgtaagttttgttatttctctcattaattctctaatatactttcttctacttcttgtatatctctcttatttctctttttgcttttctctcaggacaatatttttgtccaaatctcatattgcaaatttcggaatattaaaggagatacaaaattgtattcatttctgttacagagaatcaacttagaataaagaggctaattatgcaggtagcgaacaagagggttacgaaattcacaacaaaaatatttaatatcctcatttctttcgatatgcgaacattaaaaaaatcccaagtttctctcataaaaacttggacaatggagggaagttatagttttctgtgtcatttagacacaacttaggcacaaattagacaaaagacatagctattttatacaacaaaatagcccaataacttgtataatttgtgcctaaatgacaaaaagttcaatttctatatgtatatatagttatcaaattataaggttttacgctctgtttccgtaggtgccacctcatcaggaatactgaattcgcgattagcaaacagatcggcaagtcctgaaatttgtttcagacgcaacaattcatcacggtccataccaatatttttcattatccattgatcggacatacctgccttgtcaagttccgcaacaatgttgcacatcaattcaatgttatgcattccacgcgcacggttgtgccggatggtcgaactcatacggttagacaggtctttgtctatcaccacaatcggcaataagccgttttcacgcttatagattcgttgggaagttttcaataccgtatagcgatggtagccgtccaccagtatataatagtcttcatctttattgtagtaacatacacatggcattgtaaagccatcttcccaaatagaaagttccagcaacttcatttcaggcggtgcaacgacattcggattataatcgttcgcatatactttttctacgggtaccgcttttacctcgtaaacagggcttttatctacactcatgatactatgattctatattgttccataatttgactcctcttactcatctcctccttcgtaggtgagaatcccatatatttgcaggcatggtcatttttaagaatacaaacacacattcgcttatacgtgggtatttctttgaattccggaatgtcgatatcatcctgatattccatacgtaccggttttttcaacgttttgtagttactgttgtccataacgataatcggtactttcgcatcaatcaacttttggatggtagcatcacttagacatccaccttttgtccgccagaaattcacgctcactgaaagtttacgaagatagtttttcctcgcccgttccggcaaagtggacaacaagaaatacataaactctcgccatgtatatccttcaggaagtttcaccgactgccatcccatcgcatgagtaccgccatacataccggtaaagttcacaccgttcacccttccgaccattttgccccaggtattgggatctagcacccggtaaagttgcagactctcttgcgcttcgttaataaaaggacttgctacacgctgacgctccaaattgactccggcacgatagtaaaggtcatataaagtattataatcccactggaattttccattggccgtccatacatccgttgtcttccagtcgaatataggataggcattataaatatcattccctacttttgaagtccatttgtatttatgatacatctggaatttacggctcatatagatacatctccatcggttgaaactctcctgtgtacggattccgatcagacaacaagtgcgcactgcgtcatttttagtatgtatccattgcgcaaagcgcatctggaattcataatcccacatggttgtattataaaaaggaaaatcatctttagtcattgcctttttaggcatggaacgaacccatatattctttttattatcttcccagggacgccaaaaggattgatacatcgaggtacaggtagccacacggaaaggaatacatacccggtacacatccagaatatccttgttagcttccagcatccggtccacatagtcgatggtcattttatactggatttcataatccatgtgaaaaactcccaaacgtaccttcaggttattcttccggatataatcgatacacatattcagcagtaccccgctgtctttacctccggagaatgacacatatatattatcaaattcattaaatataactttcagtcgttcttgtgctaattcatatacattctttgtgcctgctattttctttttcgccataagttatctatacatttttacataccgtgtccatttcttgtccatcgatacaaattcaaacttttcaaatgtttctttatcttgtaccagtgtgaccgaattgagcaaccaactctcaggcccgaattccgcaataacggcaggcaacaaatgcgacaggatttcctcccgtccggcgtcttctgcctttacataataattattgattacagctttcttccggcttttctgttccaccggcacgaagcccaccacttctttatcttcaatcgcaataaaccacacatactcttcgcccgtcttgaaagggtaattattgtttgcgcgtatcacttcgggatccatcaccatcggcgccacaagccgatataaatgtttgtcttttccttttaatcgtattatctgtatcatatcattcaaaaatggacacacaaaaataaggaaaaaatatcaaattcgtcatttctgttcctaaaacatttgtttttcatgttattatctctatatttcgatatttttgaaatcacccgtccgtcattcctctctcacgtttaaagtaagtcagtatggtggcaaagcttagatattcccgcccgggagtatgcgaccggctttgaaattgataacgggcaaagatgacttcacatgccagtttatatttaaaatgcagctttaagcggtgctgtaaaaactcaaacacccgacagagatatacaaacacgtctcccactttgtcattgggaatcactcgtggctcacgatgcgtatccaatatgtgttccatttcactaagaacatattccagctgctctatttcctcgctagtgttttgcattgtacatttcatttgttctattttctcttcctgacgaatgtactgttcacgctttcgttgtaaacgatcttttatgatctctattccttttgacattataaaatttagttatatataaacggtttgaccttactgattattaaccggcaaaaatgccatataaaatctaatctcacatgcaaatatagagaagattgtttaaataattagatttttatttaaaaatattcatacttataacacatttaaattaccggcatcataaaatcggtttttccttccaatgaaacgaatcgtacttttgcggaatatttaaatattttaaacaatggatatgactggctgcttcatggctgccatgcactatccgaagtggcagtagcttattttccgaactatcagtataattgttcagcggtgaaagcattccgtcggatcatcaaagaacatgcagtattactgaaccaactcacggaagcgggattcaccccgcataccacaacgctcactcctcagcaaattgcgattattgtaaggttctggggaacgcctgcattagtatacgaaatgataaaaaagaattcatatcttgctgtcccgaaaatggggaaaaagatataatgtattttaatacattctttttttcatttatatattaatggatgaaggggtggtcgaagtgctaatataggcatgccggcctccccttttaacagggcgtttgagcaagagtagaagaaggcagacagagaggtccaaaaatatgggcaataatcaggggtattggacacatgagccaatattaaaatatttagccgttcataaccgtaaaattgtacacctcaaccaaccggactacctgtcaaataaggcatttatgaatgaatatgattattagaaaagaaaatgagtgagataacaaacccacaggacgccgaactcgaagaagtcgtgctcggtgcctgcctgctggaaagcaaagctattacactggttgccggcatattacggccggaagtattttacactgaaacgaaccgtgagatttatgctgccttgcaaagtatgtaccatgccgggcaagtaattgatatcatgaccataaaagaaaaatttgcccggcgtggcaagctcgaatttataggagggttttatacaaattgaataaccgatatgccatctttatgcccaaacaagttactcgacaaacttcttggttgccaatattggaatagcactcatgatgctctatcaatcaagtatttacgacagtccgtcactttaaacaaaaatcgtcaattaaaaagttagacaaaatttggtcaaatattcctttttattaattaaaaaggctacagtttcacaaactaatattggatttcagtctcttttccatatatttgcgcccgcatttttattattggatcaacctccttattcaatttaccaaactagataaaacaaatggaaaatataaacgcagtaattacaggagtcggaggatatgtacccgattatatcttgaccaatgatgagatttcaaaaatggtagataccaccgatgaatggattatggggcgtattggtattaaggaaaggcgtattctgaaagatgaaggactaggaacttcttacatagctcgtaaagctgtcaaacaactgataaaacgcacccatacaaatccggatgatattgatctggtaattgtagctacaacaactcctgattaccgctttccttccactgcttctattttatgtgagagactggaactgaaaagagcttttgctttcgacatacaggccgtttgcagtggttttttatatgcattggaaacaggagctaactttatccgttccggaaattacaagaaagtggtggtggtaggtgctgaaaagatgtcgtcaataataaactataccgatcgggcaacatgtcctattttcggcgatggcggagcagccgtcatgcttgaacctactactgaagatttgggtattatggatgctgtgttaaggacagatggtaaaggattaccttttttacatattaaagccggtggttccgtatgcaccccttcttattattcattggataatcaaatgcactacatctatcaggaaggacgcactgtattcaaatacgcggtatctaacatggcagatgcctgtgaatctattattgcaagaaaccatctaagcaaagacaatatcgactgggtgattccccatcaagctaatcaacgcattatcactgctgtaacacaacgtttggaagttcccgccgaaaaggtcatggttaatattgaacgatacggcaataccagtgcaggcactctcccactctgcctttgggattttgaagataaattcaaaaaaggagataacctaattctcactgcattcggagcaggatttgcctggggagctatctatataaaatggggatatgatggaaaaaacagatagcgattaatcgctatcttccaaataaaaaatcctctaatttactagaaaccagaggattttttgtttgggaagtgcggtgcgtacgggactcgaacccgtgaccccatgcgtgacaggcatgtattctaaccaactgaactaacgcaccaaaatattcattaaagcatctctctcgattgcggatgcaaaggtagatatttttttgaaacctgcaatagcttcagtatcttttttctgaaaaagtggatttattaagaattatcgtgtacatttgcagctactaataaaatagaaaatagaatgaaaaatacaccaattgaacgacatctgattgatgaaactataaatgagtttcaaattgtcgatttttcaaaagctaccattcgggaagtgaaagctattgcttcaaaagcagaagctgcatcgggagttgaatttattaaaatggaaatgggcgttccggggctccctccttccgcagtaggtgtgaaagcagagattgaagcgttacaaaatggcattgccagcctataccccgatatcaacggattgccggaactgaaaaaagaggcgtccaactttatcaaagcatttatcaacgtggatttaaatccggagggatgcgtacctgtcaccggctctatgcaaggaacattcgcttcattcctcacttgcagccaatgcgacgaaaagaaagatacgattttattcatcgatcccggatttccggtacagaagcagcagttggtagtaatgggacaaaagttcgaaacgtttgatgtatatgactaccgcggtgacaaactgaaagagaaactggaaagctatctgaaaaaaggaaatatatcagctatcatttattcgaatcccaataaccccagctggatttgcctgaaagaggaagaattgcagattatcggtgaattggcaacgcagtatgatgtgattgttttggaagacttggcttatttcgcgatggacttccggcaggatttgagcaaaccataccaacctcctttccagccatcagtagcccattatacagataattatgtattattgatttccggttcgaaagcattcagctacgccggacagcgtattggcgtaagctgtatctctgataaattataccaccgaagctatccgggactgaccaaacgatatggcggcggtacctttggaactgttttcatccatcgcgtactttatgcactttcatcaggaacaagtcattccgcacaattcgccatggctgccatgctgaaagctgccaacgaaggacaatataacttcctcaacgaagtgaagatctatggtgagagagcacaaaaattgaaagaaatcttcctccgtcacggtttccacctggtatatgacaacgacttgggcgacccgattgcggacggattctattttaccatcggatatccgggaatgaccagcggcgaactggccaaagaactgatgtactacggagtgagcgctatctctttggttacaacaggaagccatcaggaaggattgcgcgcgtgtacctcttttattaaagaccatcagtatgcgcaattggatgaaagaatgaaactatttgctgaaaatcatccgatagtctgattatttgacatgagatattcataaaagccattcttaaaatgaaaaaaaacggaaagaacgattgttattccgttttttttcttactttagtggcatgaatatcgactctgacatatttaagattcaatcgaataatgtgttaccatcaagaggaaagattttaatatctgaaccttttctgcgtgatgcaacgtttggcagatccgtaattttactggtcgatcatacggacgaaggaagtatgggattggttatcaacaaacaactgccattattcctgaacgatatcatcatggaatttaaatatctggacgagattcctctatacaagggtggaccgattgccactgatactttattttacctccatacactatcagacatccccggctctatctctatcagcaaaggactttatctgaatggagattttgatgaaataaagaaatatatattacaaggaaataaaatcagcgaatgtatccgtttcttcctgggatattccggatgggacagcgaacagctaaataacgaaatcagagaaaacacatggttggtgtctgaagaagaaaaatcatatctgatgaaaaacaatatcaaagatatgtggcggactgctttagagaaactaggcagcaagtacgaaacgtggtcacgcttcccacaagtgcctactctcaactaatattttatttcttaggattcaaacattggaggagcaatgcatctttgtagcagccctccactttcagccagtttttcaataatccgcattgaacgaagccacaagacgtgaacagctttacacaaacgtcattatctgtcgtgacatgtgcataaagctgacttaaagacagaaaatcaaaagcatattcacaaagcagcttcaatgcgtcggtggcatacccttgctgacgataatccttatgcacggcaattcctacttctccccgcgaatgaaggggaacgaaatccgtaatatcaatcgtaccaaggatacactggtcggatttgcgtaccatcatcaaacgtaattgcttatccgcaaacacatcacactgcgaaccttcaatatattggcgcaatacgtaacgggagtatggaactgtaaagttactgatgtcccacatcgaaggagcattttccatctcatacattatatccatatcttccggttctaccgcacgaagatagatacgatcgttcatcaagaaagactgtctcatagcttttcttcttttgcaatgtgaagttcgttacgcaatctcttctcactgggcaggcagaaaagtgacgccgtgaggccaatcagcatacagaggttacccgtactgctcaacgtcaggtagtaacacaaaaggttcaccacaatagctacttcaagcactcccaagcgaacaatgttccattgcacatatcgcttcaaggcaagcgtgatagtcatgtgatctatctttttcttaagcaccaagctatataatttgagagaaagaggcacacacaaagcagtaagcaaaatgccgaccgtctcaaaatagtagatagccggtgcgttatctaccaaacctcctacgggaaagagttcaaactctcctgccccaagcaaaaatgccgggagcacccaaaagaaaacataactgatattcaaatttctgacagctcgttttatctgttcttccatgttcgttcttaaataattaataatgattatacagttccggtaaaaagcgtccggttcacaatgctgcgtcctaaagtcacttcatcggcatattcaagttcatcaccaaccgatatgccacgggctatcacacttagtttaacccctagtttatccagcttgcgatagatgtagaagttggtagtatcgccctccatcgtggtgctcaacgccaaaataacttctttgattccaccttcagccacccgctgcaccaggctttcaatttgaaggtcactcggtccgactccgtccattggagaaatgactcctcccaaaacgtgataaagccctcgatactgctgggttgcctctaccgccattacatcacggatattttccaccacacagacagtggaagcatcccgttgcggattagcgcaaatctggcaagtttcagtatcggatatattatgacacactttgcagtatttcacctcacgtttcaatgttatgatagaatttccgaatgcttccaccgtagccgtatcctgacggagcagatgcagaacaagcctcatagccgtcttacgcccgatacccggaagtttggaaaattcgccgactgccttttcaagcagtatagaaggatattgttggttcatagataatatttgctgttctatcgataaaaccttgcaaagatacagattattgtttttaatacctacaaaaattgctacctttgcatctgttatgatgatactagtcactattctttgctacttcgcggtattattactaatagcccgtatcaccggacgtaagggaggatcgaatgcagcattcttcaagggagagaaccaatcaccttggtacatagtctcttttggaatgattggcgcctccatctccggagtcactttcgtttctgtaccgggaatggtgcgcggaatggatatgacgtatatgcaaacggtactcggatttttcttcggatacatggccgtagcccatatcttacttcctttatattataaattgaatctgacaagtatctacggatacctcggcacccgcatcggagtgcgtgcctatcgcaccggttcctttttctttctgctgtcacgcatgttgggaaccgcagccaaactttatctggtatgcctcattctccatacgtatgtatttcaggaaatgcacgttcctttttggctgattgctgtcggttcggttgcattggtatggatatatactcataaaagcggaataaagaccatcgtgtggacagataccttacaaacattttgcctgattgccgctctgatttttatcatctattttacaatccaaagattagaccttaatttcagcggcattgtgcaaacaatccaaaacagcgaacacagccgtatttttgtatttgacgactggatatcccgacagaacttcttcaaacagtttttaagtggtatcttcatcgtcatcgtaatgaccggactggatcaggatatgatgcaaaagaatctttcttgccggaacctccgggaagcacaaaaaaacatgtactgctacggtttctcattcattccgctaaatttcctttttttatgcctgggaattctattgatagcgctagcgggacagatgcaactcgaactgccagccatgaatgatgatatactacccatgtttgcagcccaaggttatctgggacaatccgtattggtactttttacaatcggcattatcgcagcagctttcagcaactcggattccgccctgacagccatgacaaccagtgtatgcgtagacctgctgaatacggaaaaagacacagaagaaacggcacgtcgcaaaagaggcaaagtgcatttatcgttatcagtcttattggcattcttcatctgcctggtagaaatactcaataataagagtgttattgacgccatatatatcatcgcctcctacacatacggccccctgctcggaatgtttgctttcggactttttacacgcaggcaaacgaacgaccggtgggttcctctcatagccatcttttcacccctgctttgctatcttgccgactggtggattggaaaagaaaccggatataaattcggttatgaattgctaatgttaaatggaacgcttacctttgcggggttaatctgcatgtctaaaaaagggaaaaacgatgttacaaagaaataaatgacaagaaaatggaaataacaagtgctgaatttgtgattagcaatacggacgtgaagaaatgcccggccggcattttcccggaatatgcctttataggccgttcgaatgtgggaaaatcgagtcttatcaatatgttgaccagccgtaaaggtctggccatgacctcttctactccgggaaaaacgatgttaatcaaccacttccttatcaataagaattggtatctcgtcgaccttccgggatatggctatgcccgacgcggacaaaaagggaaagaccagatacgcaccataatcgaagattatatcctggaacgggaacaaatgaccaacctctttgtcctgatagacagccggctggaacctcaaaaaatagacctcgagtttatggaatggctgggcgagaacggtatccccttctctatcatctttaccaaagccgacaagctaaaaggtggacgtttaaaaatgaatatcaatgcctatttacgtgagttgggcaaacaatgggaagagctccctcctcacttcgtatcttcctcggaagaccgcacaggacgtatggatatactcaactacatagaaaacataaacaaggatctcaatgttaaatgaaagaagaatgaaaatgaaaaagagttttttatctattgcctttttggcagtatttatgctaacggcaactaacagccaggcgcaatcatggtccgacttattaaataaggacaacatttcaaaagtagtaaatgccatcaccggaaccaccgaatctatcgacatgaccggaacatggaactacaaaggttcggccgtagagttcgaatcggataacttactaatgaaagcaggcggagctgccgcagccactatggctgaaaataaactgaacgaacaattaagcaaaataggtattaaagacggccagatgagtttcactttcaatgccgacagtactttcaccagcacggtgggcaagaaaacattgaaaggcacttactcctacaatgcttcaaccaaacaagttgatttgaagtatttgaaacttctgaatctgcacgctaaagtaaattgcagttccagttcactggagttactgttcaactcggacaaactgttgaaactaatggctttcatcggtagcaaaagtagcagtaccgcactgaaaacagttagttcactggccgaaaattacgatggaatgatgctcggattccaactctcaaaatagcaaaagaaaatcgtttaatactatttcgcactccataaagtatattttaggggaaaagcattatctttgtcgtttgtaatcaaaaagagaaggaaaaatgaaaaagatactttttttaatgaccctgttagtaatgggtgtaagcttcgcatttgcgcaaacaaatgcagatatcaagtttgacaaaacaactcacgatttcggtaagttttctgaaaacagcccggttgtcagttgcacatttacctttactaatatcggcgatgcccctctggtgatccatcaggctgtagcctcttgcggatgtacagtacccgaatatacaaaggagcccatcatgccgggtaaaaaaggaacaatcaaggtgacttataacggaacaggcaaatatccgggacatttcaaaaaatcaatcaccttgcgtaccaacgccaaaacagagatggtaagattgtatatcgaaggcgatatgacagcaaaagatgcaaagtaggaaaaaatagactattacataaaggagaatctttcggttctcctttttttttgtttactttgaggacggaaatgtaaattaacacattagcaaattataaaaactatgaaacaagaagaagacaaattcaccgggttacccgagaatgcgttcagagagttgaaacccggggaagtgtacaacccgttgatgggtccctctaaaaattatccggaagttaatatctggtcagtagcatggggtattgccatggcaatccttttttcggccgccgctgcctatctggggttgaaggtcggacaggtatttgaagcagctattccaattgcgatcattgccgtaggagtttccggagctgccaaaagaaaaaatgcgttgggcgaaaacgtgattatccagtctatcggagcttgttccggagtaatcgttgccggagcgatcttcaccctccccgctctttatattctccaagctaaatatcccgagatgacggttaccttcatgcaggtattcatcagctctttattgggtggcgtattgggtattctattcctgatccctttccgtaaatacttcgtcagcgacatgcatggaaaatatcctttcccagaagcaacagctactacacaagtgttgatttccggagaaaaaggcggcagccaggccaaaccattattgatggcaggtatgatcggcggattatatgacttcatcgtagcgacattcggatggtggaacgagaattttactacccgtgtttgcagtgccggagaaatgctggcagaaaaggcaaaattggtattcaaggtaaacaccggtgccgctgtgcttggtttgggatatatcgtcggattgaaatatgcttccatcatttgtgccggttcactggctgtgtggtggattatcattccgggaatgtctgctatctggggtgacagtgtactgaatgcatggaatccggaaatcacctctaccgtaggtatgatgagcccggaagaaatattcaaatattatgccaagagcatcggtatcggtggtatcgctatggcaggtgtgattggtattatccgttcctggagcatcatcaagagcgctgtcgggctggcagccaaagagatgggcggtaaagggaatgtagagaaaagcattatccgcacacaacgggatctttctatgaaaattatcgccatcggttccatcatcacactgatattaatcgtattattcttctatcttgatgtcatgcaagggaatctgttgcatacattggtagccattgtattggttgccggcatctctttcctgttcaccacagtagcagctaatgccattgcgattgttggtactaatccggtttcgggaatgacattgatgacactgatattggcttccgtagtgatggtagctgtcggactgaaaggtccttcgggcatggttgccgcattggtaatgggtggcgtagtatgtaccgcgctgtcgatggcaggaggttttatcaccgacttgaagattggttactggctcggaagtacgcctgccaaacaggaaacatggaagttcttgggaacaatcgtatcggctgcaacagtaggcggtgtaatgattatcctgaataagacatacggatttacaagtggcgcactggctgctccacaagcaaatgcgatggcggccgtgatcgaaccactgatgagcggtgtaggtgcaccctggttgttatatggcattggtgctgtcttagcaattattctgactctttgtaaaattcctgcattagctttcgcattgggtatgtttattccattggaactgaatgtaccgttggtagtgggtggagcagtgaattggtttgttacaacacgtagcaaagatgcatctctgaatacggaaagaggtgaaaaaggaactttactggcatccggtttcattgccggaggtgcattgatgggagtaatcagtgccgcgatgcgctttggtggaatcaatctggttaatgaggcatggttgaacaatacttggtcagaagtgttggcattaggagcgtatgccttactgattctttactttataaaggcttcaatgaaagttaaataaataattatgaggagactattatccattatagtatcgcttgtaactgccatatcatttgcgcagcagcccgtcgagctacctttgtggcccgacggtgctcccaactccagtggactaaccggagaggagcaggaaacgcgtcctcattttgtcacgaatgtcacgcatcccaccctgacggtctaccacccggaaaagccgaatggaatggctattatcatgtgtcccggaggcgggtatcgtggactgggtatggatggagaggggtatgatatggctccctggttctgcggacaaggtattacctatatggtattaaaataccggatgccgaacggacattgggaagtccccgtatcagacgccgaacaagccattcgcatggtacgccaacatgccaaagaatggaatgttaatccttacaaggtaggattaatgggagcctctgcgggagggcatttaactgctacacttgccactcactacaattcggaaacacgtccggactttcagatattactttatccggtggttacgatgatgcaagtcacccgtggaaatacaagaactgcattgctaggcaaaaatccaacaatggaacaaatacagaagttttctgccgaattgcaagtaacgcccgatactccacaagcatttatcgctcttacctccgacgacccttccgtagcaccttaccacggagtaaactattaccttgctttacagaaaaacaaggttccggcaactctccatgtttatcctaccggaggacatggctggggatttcaggatcattttaaatataagcaacaatggacacaggaattggagaaatggttgcgcgacggcgttgtattcccggaaaatcccgaacccatgttacgaatcggaaaatcttacttgggaactaaatacgtggctaacacattagatcaagacggagaagaatcattagtgatccggactgatgccgtagattgcctcactttcgtagaatacacgttggcacaggcactcggttcttcctttgccgacaatctgcaaaaaatacgttatcgggacggcatcatcaacggttatccttcccggttgcattatacttccgaatggatagagaacggaatccgccacggattcctcaccgatattactgccaaaaacagtgcgcatacccagaaaatctctctttcgtatatgtctacccatcccaagcaatataaaaaattggctgattcgccggaaaatgtacgacaaatggccgaatatgaaaaagcaatctccggaaaagtcgtacattggttgccgaaaagcgaactgccggaagccggattgccctggatcatgaatggagacattattgctattacaacgaagatgcccggactggacattgctcatgtgggaatagcagaatataaagagggaaaactgcacctgctgcacgcttcttctacattgggaaaagtagttgtcagcgacgaacctctcaatcacatgctaaacaacaataaatcgtggacaggcatacgtgttgtccggatgtctcactctaaaaataactgattatgaaacgagtaaaacatttccttctcgcctcgtgcttattccccactttgctgggagcacaagaaatggcaagcgcctattttctggaacttactccggacgcccaatcggcaggtatggcaggtacaggattagctaccaccgacaacggtagtacagctatttttcataatgcttctaccatcgctttctcacaagaagtgatgggtgcgagttattcatacgctaagatcaaccaagattatgcgctacatagcgcctctcttttctaccggatcggaagggaaggcatacatggatttgctgtaggtttccggcatttcaaagatcctaaggtgctcgattaccgtcctcatatctgggatttagaagctgcttatttcagaaatgtagccaaaaatctgtctctttcattaacgttcagatacctgcaagccaaagccgcggaaaacgcagacagcaagaatagcgtttgtctggacttcggcgcgacctactatcgcaatatggctttattggacgaaatggcttcctggagcattggtttccaagctgccaacttaggcaaaaagctggacggacaaaagttacccgccagattaggattgggaggtacaatcgacctgccattcagcatagaaaaccgtttgcaggttgcgctcgacttcaactatctgctcccttctgaaatccgtcatctccaggctggcataggagccgaatataatttcctgaaatatggtgttgtccgtgcgggataccatttcggagacaaagacaaaggagtaggcaactacggcaccctaggctgcggaataaacttctggccgatacgtgcagacttctcatacgccttggctgataaagattgctttatgcgccgcacctggcaactgggagttggaatagttttctaagttcctcttcgaggcgttgcttcacttcgtccatcggcacatcgtgctttaattcctgacgaagagaagtgacgcctttatctataaatccgcaagggtggatataactgaaataacgtaaatcggtattcacattcagagccagtccatgcatcgtgacataatggctgctcctcactccgatagcacaaatcttacgcgcacgaggcgtatcaccttccaaccagactcctgtcgctttcgccaaacgtccggcctcaatgccataagaagcacatacccgaatcaccgcttcttccagcaaatgaacgtactctttcaatcctaactgaaattcttccaggtttactatcggataacacaccagttgtcccggaccatgataagtaatgtcccctccccgatcaatatgataaagggtggcatcaattgctttcagttgttcatcactcaacagcatattattttctttcccgctacgtcctaatgtataaacatggggatgttcgcacatcacaatacggttttcataactctcgccctgaacttttgcccggacaatgttatcaaaccattctgtctgccgttgccatgcttcggcgtatggtatcaaattccaatcaataaaaaatgttttcataaaaacaaaggtaagaaataaaaagaaaatgcgtacatttgttggcccaatataacaaacacaactatgaaaatggactttccacaggtagacttgcctaccgaagtattagcatggacgaatgtaacagaagacattctcaatatttacaagcaatcttgccggttgcaagcatgtattgttgccatctgtaccgaaggttcgatgaaagcctccatcaatctgcttgattacgaaattcaccccaatgacttaataacattattaccgggaacaatcattcagtttcgggaaagaacggaaaaagtatgcctttgctttgccggcttctctgctcattgtaccggacggatcaatctgatgaagaatattggtaacgcataccccaaactgatagaacagccggtagttcctcttaatgaagaagtagccagttatctgaaagactattttgctctattatcacgggccagttgcaatgagaacttcgaaatggattctgaattggtcgaattgtctcttcagactatcctgacaagcatacgactgatatatcataaatttccgggcgaaaacagcagttcgaaccgcaaaaaggaaatctgccgggaactgattcaagccatcaccgagaattataaaaacgaacgtcgtgcacaattctacgcagataaactaggaatatctcttcaacatttaagcacgactgtgagacaagtgacaggtaaaagtgttttggacaccattgcttatatcgttatcatggatgctaaagccaaactgaaaggtaccaatatgactatccaagagatagcatattctctaaacttccccagcgcctctttctttggcaagtatttcagacgatatgtaggaatgacaccattggactttagaaacagataattttcacgaagaacgatagaaaacataaatggtgagttgcaaaacaatgaacggtgaataaattgcgcattatccgcaaagtattcaccgtctattatttacagttcgctgttcataaataacagcttgccattcatcgtttacagcttacaggttcctgtctttttatagttcgtttcttattttcgtcccaaactcaacgaattgagcactacgctcacactggagaacgccattgcggcacttgccagcatcggattcaacagcaaaccattcagcgggaacaagataccggcagcaataggaataccaatcaggttgtaaataaacgcccagaaaagattctgatgaatcagtttgaccgtctgctttgacaactggaaggctttaggaagcagcaacaagtccgatgtcatcaaagtcaccatagccacgtccatagcaatatcagttccttttcccatggcaatgctgacgtcagccaatgccagtgcctgcgaatcattgataccatcgcccaccatcgcaaccttctttccctgcatttgaagctcacgtacaaattcggccttatcgtccggtagagcgtcggcaacaaaacgttcgattcctaaacgggaagaaacggctagtgcagtccgttgtccgtcccccgtcagcatacagatgtcaatcccttgacgtttcagttccttcactgcttcggcagaagtagcctttatcgggtcggaaacagcaatgatagccagcaactcgttttcacgtccaaagtaaatgatgccgttaccgtccgattcatagtgaaccagcatttcagccatcacatcgcttactgtcgcactgaaatctttcaggagtttatgactacctacccagtaagtatgtccctcatacgaggctttgattccttttcccgtaatgctttcaaagctatccaacgcggcaggttttattttttcttcgtcctgaagcgcagagacaatagcgccggcaagcggatgctccgatttcatttccgcagctaaaagtacatctttgaaatgtggttcctgcgactgcgcccataaccatccggtagctgtaggatgtccttcagtcagtgttcccgttttatccagaacaacgacatctactttgcgcatttgttccaaagccactgcatctttaatcagaatatgctggctggcagctttacctatacccaccatcaacgcagtaggtgtagcaagccccaaagcacatggacaagcaatgacaagaacagaaacagccgacaaaataccataagagatatattcactaccaccaatggtgacccacaatacaaatgtcagaatggcaatgcccaatacgacaggtacaaaaatccccgtaatacgatcgacaatgcgctgtacgggagctttgctaccctgcgcttcctgcaccatagagataatacgggcaagcacggtttcactgcctacctgtgcggcacgaatgataaatgagccacgctggttgatcgtccctgccaatactttatcacctttcttcttttctaccggaaccggttcaccgctaatcatactttcatcgacatacgagtcgccttcggaaagctgaccgtccacaggtatttgctctcccgggcgtacaaccaccaaatcacctacctgaagtttttcaatcaagatctcctcctccactccattgcgcagaacacgagccgctttaggctgcattcccatcaacttacgaatggctgtcgaggtatttcctttggcacgttcctccatcaactttccggtaagaacgaaagcgataatcaccgcagaagcctcataatagacatgcggttccaatccgcggtcataccagaattcggggaagaaagtgttgaacagactgaacagaaaagcaatggaagtactaagcgcaaccaaagtatccatattgctccgtcctaatttagcctgtttccaggctccggtgaagaaaccgcctccgaaaaagaccataacagggatagcaagtaccatttgaatctcattagagtatggcacatgcatcagtatcatggaatataccaataacggtactaccaaaatccacgcaccaatcaccttccacttcaaacgagtgtaacgcttatgctgttcctcttcccggcgttcttctttgtgggcttcttccacaatcagatcataacctgccgcaagcacagccgcacgaatctctccgggagtcagctgctctttctcataagaaacggtcaatgtattggtagcaaaattaacggaagcctcaatgactcccggcaatttttttactgttctttctacattattggcacatcctgcacaatgcatattaagcacaggaaatgccttttttgttgtgttacccatataattattgtttacggccttcccctcctctcgaaaaagaagttggggaagaacccttgtttgtttatagaaacaagctaatacaggtatttgttcaattacttcttatcagccttctgatcgtctttctttgtttcttttacaaattcggcttcataactgaacttattaaaccctgcctgcaacttctttacattcgttttttcagcgtcatacgtaatggttaccattttcgtttttacttcggtcgaaatatccttcagccctttctcaaaacgcatattgtcctttactttcttttcgcatttctcacagtgcatctgcgacactttaaatacaacaacacgaatatcttttgccaatacagctgttacactcaaaagagccaccacgcaagtggccatccatctttttgttctcatttttcttatcagtttaaaattaatattctttattatgcaatcgtttctttcattcgctatttcctgcttttactcactatttctagctaagttaaaacgtattccgatatatccttttgctccgtgcaccggtccccaaatcatggtagaatcaaaattgttcccccagggatttgccgcatcgataatcggattcttttgtttgaaatttgtcaggttctcgcctcctacgtagatagaccagcggcggaagtaacgggtcacctgcaagctcaactgctcaaaactgccataacgacgttcccaagacaactgtccgtctcccaactcataaggagtaggcatcctgccgccgccattcagttgcagtgtggcgtcaaactgccatattcccagcggagtttggtaagaggccgtgagtagtcctttatatttgctggtcagcggtttctccattcgttcacctttgtaggtcgttttcgcatccgtgagccggtaagcacctgtcagggtgaatcctttgaagaaaggatgacttgcttccacttggaacacatgcgaataagagcgtccatccaaattgtagaaagctacttcatgggggttgctatccatatctacgatcacttgtttcaggaaatccgtataatagtattctgcattcacattcagcgttttgccgaatatagggatataagtagagacgctggcaccgtaattccacgcttcttccatatccaggttctttgctatttccaccttacgactgctggaaagcaggtagttgttttccgccaacacatgattggtacgatacccttttccggcagaaagacggaaattcacataatcattcggattgtacttaagatgcgcacgcggagtcacgaagaaaccatgttggttactgtaatcaccacgcagaccggccattaccatccatttatcattcaggttcaacgtatattgcacgtaagcaccgggaacagcttccttttcaaaggctttgagaggattgtccgttgtattttccaaacggtaatgttggtcataagcgtcataattgaagctcccccctgcggagaaactattttgcggattaaattctgtttcaaacatcagcgaagcatagacgttggtttgatccacattatacagtttgcgtccatacgtagcatcctgattatgtaaagtggtggaaagaatcaaagccaggttcgtattcttctccttattaaagatataggcattcttggtgaagaattcatagcgttctgtatcgatccctactttatacagatcaccggagtgcattgttcctccatgattggcctgtccgctggtacgtgtttcagaaagggctttgatacctgcctgaaaaacataatggtcgcccatatatgcccaccggttccacacattatattgttccacctgcggaatatccacaaatccatcatcattaccatcatgcgccttggtctcattttcgtaatgtgccagcagagaagtgctccatcgtttggaaattttcaatgtagcgtccgcattggcttcataccggttggtagtgcttgcaaaaagattggcagacacccaatcggcttccggcaactgcggtttcttaaattctacgtttatctgtcctgtgatggcttcatagccattctttaccgaagatgttcctttggaaacctgtatgctttgcatccacgggccggggacatatcctaatccataaggagcggcggctccccgataattcggaatgttttccgtcaacatctgcacataagtgccggacagccccaacaatttaatttgtttggctcctgttgccgcatcggaataactcacatctactgaagggttcgtcacaaaactttcccccaggttacaacaagcggctctactcaattcggcactgcttatcatgtcttcgttcatcacgctactgcgcaatttcatcgttcccagtttacgagtgacaatatttacttcattcagttccactccatcacgaagcacaatatccagttgttgatttttactgctcacatgaatcgtgtcgttctgaaaaccgataaaactgacaatcagcatgtggcttttggaaggtttagtgatagaaaaactaccatcctctttcgttgtcactccttgtcctgtattcatccagaacacattggcacccggaatagcctccccggtactatctttcactgttccccgtacttgcgcatatatattgccggcaaataacaggaacagtcctattatcatatatttcattctttctaaagttactttcgagatacaaaattaattcatttctcatgcaacttagttgcattcagtgctgctttactttcatgttctattgaaagtaaaggattaaataagaaagaaatagtggctaaataatgtaagtggaatataacgccagcatctgcctcgagcagagaggtggcggagaggtcagactatcaaattctaccggtttatccgcataggtcggagtcagcagatagcagaaatgctcacataaaagatcgactgccaaaactgatacggtcagttccgtagagtgtttcatcaggtcgagcttataaatcgtagccgtacaacctttttctttgcagtttttctttgaatcgcaagtatgagactttttacacttcggacagcctgtatcacagcagctctgcactgtctcacaacgggcacagcaataacgcacaatagagactccgcctcctgaatagataatcaggagagaaaggattagtgctgttatgtaggctagtcttttcatttcagaggacaaagataagaataaaaacaaattttcctatctattttcgtaattaagattcaatcctcattcaaaactatagatatacatgcatttcttaccggttcttcccccaataacctcgtattccatcatcagtagattgaataccaattcattgcagacatatttcccgttcattatttggctattttagggtcatatcagcactattaactctttttactcaacaataaaacctatctttgccacgaataaattcattgtttttttaagtaaacgctatgcttacatatctactcctcattatcactctttatctggcagggaatacctacatatttatcagagcgacgcaggctctgaaagtaaaaccgcttggagtaaaattactcttaaccgttttattttggacatgtgccttatctttcttcggcacgatgttagcccgtaacctggaaatgcctgtccttatctcccattcgatgtacatcattggaacaagttggctgatatttaccctatacatggcattattcctgctgttgtttgatatattgagattattcaaggttgtctgcaaatatcgtttttatctgtctttggtgtttacattaggattgctgggatatgggctatacaactatcaccatccggaaaccaatatagtcaacattttaactaataaacaaaatgaagatacttctcacgcagttaaaatcgtcgcgataagcgatgttcatctgggaaacggcacaggaaaagcctcactgaagaagtatgtggaaatgataaatgcacagcatcccgacttgatactgattagtggcgacttaattgataacagtgttgtacctctttatacagagaatatggcggaagaactggccgagttgaaagctcctatgggcatctacatggttcttggtaatcacgaatacattagtggaatcgatgaaagtatccgatatataaagaatactccgatacaacttttgcgtgattcagtagtgacactccccaacggcatacaactgataggccgcgatgaccatcataatcgcaaacgccgttccctgcaagaactgatggcgaatgttgataaaagcaaacctatcatcttgctggatcatcaacccttcaacctgaaagaaacagaagctgccggcgtcgacctgcaattcagcggacacacacatcacggacaggtatggcctattaattgggtgactgattatatattcgagcaaagccacggttaccgccaatggggaaacagccacgtgtacgtgtcttccggattgtctctttggggaccgcctttcagaataggaacgcatagcgaaatggttgttttcaacttccaatgaataatatgcagttttgtcacatatgttacagtttctaaatggacgtagatacccttatcgaatttctgaaaatgaaagggaaatttatgcctgctgaagatggattcaccgtggatatcactaaagtttgcaagcattgacgtgtggatggtatccggcaatcctgttttagaggataaatagctgcaaatttttctgtttttattagcccgattcacgaatttcatctatatttgtcaatagtgaatgataatacaaatgttgaatttatagaaaaaacgggtatgaaaaaacaatatgtcagtctgcttgcaattatactttcggtaagcggctttttgttttcttgtcatgacaagatgaacaaaaacacaggtgcgttacagtttgatagcattcaagtgaatgagacagcacacctcttcagtgatacagccaaaccggcctgcaatattattattaattttgcctatccggtaaaatcatcggatgatatgctgaaagatagtttgaattcttatttcatttcggcctgcttcggtgataaatacatcggcgaaaagccggaagaagttgtaaagcaatataccgagaactatatcagcgaataccgccgcgacctcgagccgatgtatgccgaggacgagaaagacaaggaagacgaatcttccatcggagcttggtattcttattataaaggtatagagagccacgtacaactgtatgataaagacctgcttgtatatcgtatcgactacaacgaatataccggaggtgcacatggcatttacatggctactttcctgaacatggacctcaccctgatgcgcccgctccgtcttgatgatatttttgtcggagactacaaagacgcattgaccgacctgatctggaaccagctcatggcggacaataaagtgaacactcacgaagcattggaagatatgggatatgcttccaccggggacatcgctccgacagaaaatttctatctaagcaaagaaggaatcaccttctattataatgtatacgatatcactccttattctatgggacctgtaaaggtaacaatcccattttctatgatggagcatttactaggcagtaacccaattctaggagaactgaaaaattaaatttcataaaaagctgaacaccaatgaatatcctattgttatcactcccgtgtgacagaataggatattcatccacatctatcattcaaaacttataactcaaaactcaaacagtggaaatcatactgaaatattttcctgatctgacggaagagcagcgcaaacagtttgcagctctatacgacctctacattgactggaattctaaaatcaacgtaatctcccgcaaggacatcgagaatttatatgagcatcacgtgctccattcgttaggcattgccaaaacaatccaatttcgccccggaaccagcattatggacctgggtacaggaggaggtttccccggtattcctttagccatcttatttcccgaagtgacatttcacctcgtggacagtatcggcaaaaaagtacgggtagcaaccgaagtggcaaacgctatcggactgaaaaatgtaacattccgtcatgcccgcgcagaagaggagaaacgaacgttcgactttgttgtcagccgtgccgtaatgcctttggcggatttgattaagattatcaaaaagaatatctcttcaaaacaacagaatgcattacccaacggactgatctgtctcaaaggtggcgaactggagcatgaaacgatgccgttcaagcataaaacggtcattcataacttgagcgatagtttcgaagaagagttctttcaaactaagaaagtggtatatgttccgatttaaacaagactatatgttctgatagatgataaatcataaagaaaccatgaaaataaagagatttgaatttaatatgtttcccgtaaactgctacgtattatgggatgacactaaagaagcagtcgtaatcgatcccggctgtttttatgaagaggaaaagcaggctctgaaaaagttcattcttaccaatgagctgaatgtaaagcatctgctgaatactcatttgcacctggatcatatcttcggaaatccgttcatgctgaaagaattcggattatcggcagaagcaaacaaagcggatgagtactggattgacgaagcaccgaaacaaagcagaatgtttggttttcagttacaggaggaacctgtaccactgggcaaatacctgcatgacggagatattatcactttcggacataccaaactggaagcgatacatgtgcccggacattcacccggtagcttggtgtactattgcaaggaagacaactgcatgttctccggcgacgtcctgtttcagggcagtatcggtcgtgccgatctcacaggaggcaacttcgatgaactgatagagcacatttgtagccgtctgtttgtcctccccaacgaaactgtcgtttaccccggacacggtgctcctacgacgatcggaatggagaaagctgaaaacccattttttagataagagaagatttaatgagttatgaattctgatttatgatttgccgtgcggatggagtaggtgttgcggctaattgaggtttataaatcggaaaaacataagaaagcataaatcagaactcataattcagaaatcattaatcataaatcattaagacatgaaaaccgatttgttagctagccgtcacatcggcatcaatgaacaagacacagccctgatgctccgcaaaattggcgtgaactcactggacgaactgattgataaaacaattcccgccaatatacggctaaaagagccgctggcattgactagtccgctgacggaatacgaatttggaaaacatatcgccgaactggcaaataaaaataaactatatactacgtatatcggtttgggatggtacaacacgattaccccggctgttatccagcggaatgtattcgaaaacccggtatggtacacttcttacactccttatcagacagaagtgtcgcaaggacgcctggaagcgttgatgaattttcagacagccgtgtgcgaccttactgccatgccacttgccaactgttcacttctggacgaagcaactgccgctgccgaagccgtgagcatgatgtatgccatccgttcccgtgcgcaacagaaagccaatgcgaacgtagtctttgtagacgagaatatcttcccacaaacattggctgttatgactacacgcgctgtgccgcaaggcatcgaactgcgtgtaggtaaatataaggattttgaaccttcaccggaagtgtttgcctgcgttctacaatatccaaactcgaatggaaatgcagaggattattccgaatttacagaaaaagctcatgccgcagattgcaaggtagctgtcgctgcagatattttaagccttgccctgctgactcctccgggagaatggggagcagatattgtattcggaactacacaacgtttgggtactccaatgttctatggtggtccgtcggctgctttctttgctaccagagacgaatacaaacggaatatgccgggacgaatcatcggatggtctaaagataaatatggcaaactttgctatcggatggctttgcagacacgtgaacagcatatcaagcgggaaaaagcaacttcaaacatttgtaccgcacaagcattattagctaccatggcaggcttttacgctgtttatcacggccaggagggtatcaccacaattgcgtcgcgcatccacagtatcactgtatttcttgaaaagcaactgaagaaatgtggatacacacaagtcaacgctcaatattttgacaccttacgttttgagttgcccgaacatgtttcggcacaacaaatccgtaccatagcgcttagtaaagaaataaatctgcgttattatgaaaatggtgatgtcggtttcagtattgatgaaacaacagatgtggcagccgccaatgtattgctctctatctttgccatcgctgccggaaaagattatcagaaagtagacgatatcccggaaaaaagcaatatcgacaaggctttgaaacggacaactcctttcctgacgcacgaagtattcagcaaatatcacacggaaacacagatgatgcgttatatcaaacgtttggatcgcaaagatatttcgcttgcacaatcgatgatttctctcggttcatgcaccatgaagctgaatgcagctgcggaaatgttacctttaagtcgtcccgaatttatgggtatgcacccgctggttccggaagatcaggcagaaggatatcgggaattaattaagaatttaagtgaagatctgaaagttatcaccggatttgcaggggtgagcctgcaacccaattcgggtgctgcgggagaatatgcaggacttcgtgtaatccgtgcttatctcgaaagtatcggtcagggacatcggaacaaagtcctgattccggcttcagctcacggaacaaatcctgcgtcagctatacaggccggatttgtgactgtcacctgtgcatgcgacgaacaaggaaatgtagaaatggatgacctgcgtgccaaggctgaagaaaataaggatgaattggcagcgctgatgattacttatccttctacacatggtatcttcgaaacagaaataaaggaaatttgcgacatcattcatgcctgtggcgcacaagtatatatggatggagccaatatgaatgcccaagtgggattgaccaatccgggattcatcggtgcggatgtctgccacttgaatctccataaaacattcgcttcccctcatggtggcggaggtccgggagtaggtcctatctgtgtggccgaacatctggttcctttccttcccggacatggaatcttcggcaattcgcagaatcaagtatcagctgctccattcggtagtgcaggtattttgcctatcacgtatggatatatccgcatgatgggtgcagagggattgacgcaggccactaagatcgccatcctgaatgctaattatctggctgcttgcctgaaagatacgtatggagttgtctatcggggagccaatggtttcgtaggacacgaaatgattctggagtgtaggaaagtacatgaagaagcaggtatctcggaaaatgatattgccaaacgtctgatggattatggttatcatgctcctaccctctcctttcctgttcacggtacattgatgattgaaccgacagaaagcgagagtttggcagaactggacaatttcgtagatgtcatgctgaatatctggaaggagattcaggaagtgaagaacggcgaagctgataaggatgataatgtgttgattaatgctccgcatccggaatacgagattgttagtgatcgttgggaacattcgtacacacgcgaaaaagcggcttatccgatagaaagtgtacgtgataacaaattctgggtcaatgtagctcgtgtagataacacattgggagaccgtaagttactaccaactcgttatggcacttttgaataaaggtgatttattgtagaaatcaattcattagaaaagatttttagaagcgtctcaataagaaataatcccggggctcaatgaatgtaagccctgggattatttttatcagcccaagactgaataaacaaaagccctggggatgcatcaaatatccccaaggctcatattttgtgatatggaatgtaaatccaactacaattctgaatattttttctacttgacaatcgttaccgtatcagccttcacctttttctctttcatcggaatcttcgaatcagcataccccaaagctacgcaaccatagactttatgattggcaggaacacctaaagaggtaatatattcacgaacttcaggatcatcacacgttgtgcccaactggttgatccagcaagagccgattcctaaagaatgggcagccagaaacatattttctattgcacaagcacaatccataccagcccaccattgtgtaggttcattggatacaatcaccaaagtcggagcatgataataacaacaataggtcttgctatgcccacgctcttgcaaacgggaatcatcactttttgcaaaagctcctttaatgcgctcattcagttctgtcaatttatctacattttgaatagcagtaaagtgccatgtttccaaatgcattccactgggtgcataagttgcagcttccagaatagcctgcaaatcttcttctgaaacttgctgactagtataagcccgtacgctacgacgtgctttaatgttctctaaaacttcattcgttttcatggataacaagttttttatatatatcgaatcaaaatttcaccacagaattctaatttatcatttaccttttaactagcccaatctttgcattcagtttgaaataatagactccattctctctctccaaaaatccgtatttatccttctccaaagatcctttttccaaacgggtattttgaaacaaaaagtcttccattacttgcttttctgatttatgataacagagcacctctccacttccgcccaccaacagaataccttccacagccgaatccaatctattataaatctttgcgggacgcatacctaaagctaatgccaacaagaactgcttcatcttaaactcataaaacttgtgcttgtttatcagttcatctttaatctttaacggattcatttgtttgataacttccgtcagctcgctaatacgagagataccatccaaatgcataatacgaaccatttctgtcaagacacgtggaaaatgcaggtcaatcattagaagattgctacggaatacccggtcggctacatcagaatatttaagtacaccgcccaatcgttcgatcatcatcattcgctcggcaacctcattgggagattcaggcaaagcattgattttattcactgtgggagtggcaaatttgactccactctgttccagttttagatttgcagcacgtcctccgtccagtaacggattcattacacccaaccgtgaacgaacattaaaacctctaaacggagcttccggatgccaaaatgcaatggagaaatcagtacgatcttctgtttttgcttccaaatcgaaaatggctgcttcatctaaaaactcttctactccttccggagaggttacgtcctcttccgaagaagatttcacagcccgcaatatcaaatcagctacaataccaaagtcttcgcgaggcatgaatttagttccgctctctgcttctatacgaatcgtatcttcctcaatataatattgacgtgttccatcatgttcttcccgttgaatcattgcaataggccaagatgtttctcccgcctttgcgtctgctgtgcctagcactacttttccgtctgtcaggagacgaaagaaagaatagagttcgcaccattcttttttggttgcttcgaatgccatatatctttgttcttctttattttactaatgttctttttatcctaatttcactaagaaatttctatcttcacaatgaattgcttactgattaataacctgcggtaaggttacaggcaacgcaacaggaggtactatatgagttacttcctccaaaggaggaagcttgcctacttgtgcaaacagggagtttcgaatccattctttaggagtgactatgataaatcgtcccgtccagcaaccatcaaaataggaaggattgcccggctgtttctttattggatagcagatattttctcctttactccgcatctccggcgaacgtccggggtcatttacccacacatgtttatcgtcaatgccacgaagcaccatccagtgccctctcggaccgggacgcaaaccacgaactgctcctgtatatctcacattcacaagcacaggtataccacgatcaatataatctttcaatacccggtaatctttctgctgaaaatgttcggcacttatcatattttcataataacgtgtcaaagaatcaatttcaaaagaataatatcctccctgccctatcgatgtacgacgacggaaaggggcacgttttttcagaaagtagttacgctgatactcaatcagtttcttttctgcatcctgggctgtacgttgtgtatcggtcgtcatgcctttaaagtagtcaaagaccattaacgaagaagccagagagcaatgcgagtaaggacatcccgtgattttctgcgaataccacggaacagggatattattaggagcgagcttttgagtctcctgtacttgtgcttgcgtctgaacgcttatcaaagcaaagaagcttaaaaacaaattgaaaattatatgatatttatttctcatgcaatattttaaatatcttacttacaatacattctcatcatcaagaatacgagctgtctccaccttttccaaacgagcacgcaatttaggcatcatcgaacgacgaatacgtaacgtcatactacaatccatgtcatacgactgattgagaatttccggttcctcctctttcacaatgcgcatcacgtcattcatgaaaggatattcaaacattaccgtcacgtcttcatctactgtcttttctataattgtagcggcagcaatagcttcagcagcggcagccttgtaagccacgatcaatccgcttgtccctaacttgattcctccaaaataacgaactactataatcaggatatccgtcagttcatttgaatttatctgtccgagaatgggttttcccgctgttccggaaggttctccattgtcattggcacggaaatcctttcgtgcagctcccaacatataggcataacatacgtgtcgtgcgtcataatactttttctgatacgtttcaagatgtatttttatctcatcgagagtacgcacaggaagggctatagcaatgaacttgcttcgtttttccgtataaataccttcggaaggttcaatgatggttttataagtatcttcagcagtcatgctgcaaagatacggctttaataagaaaagtcaatctatcgtttggaaatattaatgttccacttatcgatgagatgtagctggaaatataaaaatctttgttggcagattttcatctataagatagtgacgctatccaataaaaatagtgacagtataccacaaggataccgtcactatcccgggcatataccgtcactattttttttatcttaatcgggtgttacatttattgatatagcttacatcagcaacgtcttttttgcatcatccgatagaatttcctaatccaatttatgaattaccaaccccgaacgaagtttaggttcaaaccaagttgtcttcggtggcatgatattacctgtatctgcaatatccatcaattgtttcatagatacgggataaagagccagagccactttcatttcaccgctatccacacgtttcttgagttctcccaatccacggatgccgcccacaaaatcaatacgcttgtccgaacgcaaatcctttatacccaaaacttcatccaaaatcaggttggaagagatggtaacatcaagcacgccaatagggtcgttatcattgtatgtacctgttttggctgtcagactgtaccatttaccacccagatagagtgagaagttatgtaagccggatggtttatagatatccgcacccttctcttctactataaagtttttatcaagtgcagccaggaattgctcgggagtcaaaccattgagatctttcactacacgattatagtcgatgatggttagctggtttgcagggaagcaaacagccatgaagtaattatattcttcatcaccccgatgattcggattttgctttgctttctctgctcccactagtgcagcagcggcagaacggtgatgtccgtcggcaatataaagagccggcattttagcaaattcggcagtaatagcagcaatatcctcatcttgatcgacaatccagaaagtatgtccaaaaccatcccccggagcgatgaagtcataaacaggcttgtttgccgtatacttcttgataataacatccaacttctcattatccggataagcaaagaaaacaggctcaatgttagcgttgttcacacggacatgcttcatacggtcttcttccttgtcacgacgggtaagctcatgttttttgataatcccattcatataatcgggaacgtatgcaccaactaccaatccgtattgcgttttcccgttcatcgtttgggcatagatataataattttccttattatcctgcaccaaccaacctttgtcctggaacagttggaaattctcggcagctttagcatacacttgttcgtcgtgttcgtccgtaccgacagggaaatctatttccggtttaataatatgataaagagacttttcgttaccttccgcttctgcgcgggcttcttctgaattcaatacatcataaggacgtgaagcgacctgttctacgaggtcttgcggaggacgaatgcccttgaaaggtttaattattgccatgatattagtattttatatgtaaaaaattaaagccacagacttattgaaaatctgtggctcaaatatactacttatttctaaaagaatcttatttgtttactctaaatttctcgcaaccatctttcaggaagcctacaatttgttgagcggcagcaataccggcattgatatttgcttcagcagtttgagcacccatcttctttggagttgagaaataacgtccggcaaatttctctgcaaattctgcgttagcaacaggcataatatctgtgatatatttgaagtctgcacgctcttccatcaatttaatcagttctgcttcgttgataacttccttacgggcagtgtttaccaacatagcacctttcggcatatctttcaacaaagcataattgatagaatttttcgtttcggcagttgccggaatatgaagagataccacctggcaagtcttatacagttcttctgctgaaccaagtgctttcacaccatctttttcgattacttctttcgggcagaatgcgtcgtaagcatacacttccattccgaaacctttggcaacacgggctacattacgacctacgtttccataagcatgaatacccagtttcttgcccatcaattctgtaccggaagttccgttatagaagttacggacagcatataccatcatacccaaagcaagttcggcaacagcattagagttttgtcccggagtgttcatcacacatacgttgtgagcagtggcagcagccaggtcaacgttgtcatatcccgcaccggcacgtactacgattttcaattctttggcagcatcaagcacctctgcatcaataatatcgctacggataatgatagcattagcatctttcactgcatccagcaattgagccttatctgtatatttctcaagtaaagcaagctcgaatccggccgcttctatttctttacggatgccgtctactgcaactttagcaaacggtttttctgtagctacaagtactttcataatttaattctatttataaagactcaccacagattacgcagattttcacagattatagaatttaggaatctgtgctaattcgtgtaatctgtggtgaaaataatatattaatgaagtttttcaaattcctgcatgcagtcaatcaaagcttgtacgctttctttcggtaaagcattgtagcaagatgcacggaaaccacctacagaacggtgtcccttgatacctaccatacctctttcagtggcaaacttcaagaagtcagcttcaaggtctttgtattcgggagccatcacgaaacagatgttcatgcgtgaacggtcttctttggcagcagtacccacgaacattttgttgcggtcgatttcagcatacaacatatccgctttttcaatggcacgacgttccatttctttcacaccaccttgtgctttgatccaacgaaggttcagcaatgcagcatagatgggcactaccggaggagtattgaacatagaaccattatcaatgtgtgtctgataattcagcattgacggaatgtaacgagaaaccttacctacagcatcattcttaacaataacgaatgtaacacctgcaggagccagattcttttgtgcaccaccataaatacagatatatttagaaacgtcgatcggacgtgagaaaatatcagaagacatatcggcaaccatcggaaccggagaatcgaggtctttcttcaattctgtaccataaatcgtgttgttagtagtgatgtggaaataatctgcgtctgtcgggattgtgtaatcttttgggatataagtatatgtagcttcagcagaggaagcaacttctacaacttcaccaaaccctttagcttctttcattgctttcttagcccacacaccagtgttcaggtaagcagcttttttttccaggaagttataaggaaccatgcagaactccatactagcacctccacccaggaacagtaccgaatagccttcgggaatattgagtaattccttgaataatgcctctgcttcgtcaaccacaggttggaagtctttggcacggtggctgatttccatcaaagagagaccagagccgttgaaatctaaaatagccttcgctgtatcctctatcacctcacgcggaagaatggaaggtcctgcattgaaattatgctttttcatttgaagtttgtttttggtttaacaatttcgttacttttgtcttttgaccttgcgaatttacgaatttattcccatcgcacaaatctttccttataaaaatactgttttaaagcagattttcctttctttttattggtttatacaggatatatacaccatattgctatctatagatgtcaagtatgggataaaagtcgagattgaaatagaaccggagatattgatgataaaacaaaagattaatgcaataaaaatgaatatttataaactacaacagtgaattcagcttagattaacagggaaatgaagtgaaaagtaaaacatctttggaaataatgtaatcatccctatgctcaatgactagtgaacatagggacgattgtaaataataaaagaggactttaagagttctatattacaaaaaaagagttttacttcgcttcctcaataatagtcttcattccttttattttctctccttgaatcagattcaggagttgcttcaccttagctcggcgaacggcaacgaaagcataatgttctttgacatcaatcgctccgacatcttcgcgagtcagatttccttttttatataagaatccggcaatatcgatccgactaagtttctccttctttcctttacctatatatatagtagcccagagcgatttcggaggccggggagggttttcaggcaacactactatctccatttcttccgggatataagaaggaagtttctcttcggtatgaagaatcagataagacgttccggtcgcatcccaacgtgctgttcgtccgttgcggtgcgtaaaggcttcttcattgaccggcaaatgataatggataatatgtccgacttccggaatatccagtccacgagcagccagatcggtagaaatcaatacatgacaactgccattacggaacttgtaaagcgcacgttcacggtccggctgttccataccaccatgaaaacgttctgcgagtagttttttatccgccaataactgatgtacacggtccaccgcatcccgatgattacaaaacacaatgctcgaactgctccccaatgtacaaagcaggttatataaagtatcaatcttatctttggaaggcgaaagcaccttcatcaatttcaagcgcgactcttgttcttcagaatcgtccgaaaggaagttcaacttaactgtgcggttcaatcctgtaaattcgggaatctcttcggcatcggtagctgaaagcaacatacgtttttttaatcccggaagctgggtgataatctctgccatttcatcgtggaaaccaaactccaacgatttgtcgaactcgtcgataattaaagtttcaatggtttcgggattgaaatttcctttagacagatggtcggtgatacgtcccggagtaccaatgatgatagcaggatgattgcccaatatacttttcttttcttcggcgataggatgcccaccgtaacaacagcaggttttccaggaagtccccattgctttgaatacagaatctatctgtaaggccagctcacgcgaaggaacgagaatcaaaacctgcacgctgtcatcgttcggttttagagtaaggagtaaaggtaacagataagccaatgtcttgcccgatcctgtcggtgacaacagtataacgtcttttcttccggtagcttgttcaagtgatgcttcctgcatcggattcagctcctcaatcttcaaattgcggagagccgactgtataatttcatttttctctaacatgggggcaaagatacaaaaaggaaagagtacggagataaaaatgcaatcaaactttagccatgccggtcaatatataataacctttcagattattctctttcatgtaaatggttacttctgccctacaagctgtcaccaaggcatatcccgttaaacttgaactcatagctttgacaaatgaatactctgtatcattgtgaataaaagatatacgatgatattccataacctattgtactttaataattctattgtgtagccaaatatacgaatataatagataagtacggataaaaaaggagaactatctttaaaacagacataaaatagatacaaaccataacggaaagacattatgagataatagtaaaaaaaagcgggaaatcgaagaagcattactgcttttcagatttcccgctctgtgtttatgtaacctttccggtcattgttccgaccggtttgttctcttctgcgaattatcctccgaagttgtcgaacatcaggttctgtgccggaacgccaagatcgtcgagcatcttctcaacagctttcgacatcggaccaggaccacacatatagtattcaatatcttcaggagcttcgtgattcttcaggtaagtttcgtaaattacgttgtgaacgaatcccggagtgtacttcacgcctgcagcatcagcagcagggtccggacggtcgagagccaaatggaaagtgaaattcgggaagtccttttcgatttgcaggaaatcttccagatagaacacttcgttcagcgcacgggcaccatagaagtaagacatcttacggtcagtagtatgcaatgtcttggtcaagtgcatgatttgcgcacgcaacggagccataccggcaccaccaccaatccacatcatttccttcttagaatcgaagattgggtggaagtctccgtaaggaccgctcattattaccttgtcacccggtttaagagtaaagatataagaagaagcgatacccggcattacgtccataaatccaggaccttgttctttcggtttgaacggcggagtagcgatacgtactgtcaacatgatacggtcaccttcggcaggatagttggccatagagtaagcacggattgtttcctcgtcgttcttacacttcaaacccagcaaaccgaatttctcccatgcaggaagatattcatcaccaatcaagctcttgtcaatgtccttgtcatagtccattgagaatttaggaatcttaatctgtgcgtaagaacccgggataaagtccatgtgttcgcctttaggcagagcaacgatgaactctttgataaatgtagccacgttcttgttggagattacttcgcactcccactctttcacgccaagtacagattcgtcaatcttgattgacatatcgcctttcactttcacctgacagcccagacgccagtggtcttgctgctgtttgcgactgaagtgaggaacctcagaaggtaggatttcgccgcctccttcgagtacttggcatttgcactgtccgcaagatcccttaccaccacaagcagatgacaggaatatcccatttacagacagcgtattcaacaaagtagaaccggaagccacttccaattccttttcgccgttgattgtcagttttacgtttcctgatggtaccaggaaattcttagcaaccaacaagattacaacaagcaacagaataaccacaaggaataccccaatgctcgctaatattaaattcatatccattgtcttattcctttctttttagatgttcaaaccagagaaacacataaatgcgattgccatcagacctactgtgataaatgtgatacccaagcccttcaacggagcaggtacgtcagagtaagccattttctcgcggatagcagccagacctacgatagccagcaaccaaccgataccagagcctaatgcataagaaagggcatcccaaatatcaccaatgtatttcggatcactcggacccagattgatacgttgttgcataaacagagaggcacccatgatcgcacagttaacagcaatcaacggcaggaagatacccagcgaagcgtacagtgacggagtgaagcgttctaccaccatctccaccaattgcacgataccggcaattacggcaatgaaaagaataaaactcaagaagctaaggtcgacaccttcaatgatagcattggcagccaacaccttagtttgcaacaggtagttgaccggaagcgtcaccagcaacacgaaagtcacggcgatccccagtcctacggcagtcttcacattcttcgaaacagccaggtatgaacacatacccaagaagaatgcgaatatcatgttgtccacaaagatagagcggacgaataaacttaataaatgttccataattctttttgatttatgatttatgatttataatttatgattcagcagacttatcatgcgactatgactataaagctagacataaatcataattcagaaatcagaaataattaattactttgttcttgcaattctttatgacgtgcacgttgataccagataatgcatgctacgataatcaatgccatcggcggcatcaacatcaagccgttgtttacgtatccgatattttgaatcggttcataattcaggatattgaaaccaagcaatgttcccgagccaaacagttcgcggaagaaagcaacgataatcagaatcttggcatagcctaaaccattacctacaccatccaagaaagactcccaaggaccgttctgcatggcaaatgcttccagacgtcccatcaagatacagttggtgataatcaaacctacataaacagagagctgtacgcttacgtcgtaagcaaacgctttcaggatttcacttacgatagttaccaaagcagctaccacaaccaactggacgatgatgcggatgcggttaggaatcgtcttacgcaacagtgaaataacaacgttggcaaatgcagtaatcaccgttactgaaagtcccatcacgatggcaggctccagctttgcagtaacagcaagtgcagaacagataccgagcacctgtacggttaccggattatcaattcccagcggagcagagaatacttctttatttttctttgaaaacagttgtcccatattctatctttctcctccttattatttagttaaaaaactcaagtaactattcaggcaagacttcaacatggcatctacacctactgaagtgattgtaccaccggagataccatccacttggtaatcaggtttctctaccttgccattttttacgactcccaaagtgatagctccattttccaaagtcttcttacctacaaattcattttggaaatggtcggttgcaatttcagcacccagacccggagtttcactagcgtgtgagaagtaagtaccgtaaacggtatctttatcttcgttcagtgcaacgtatccccagatagcgccccaaagaccggcaccgtaaacaggaactacatatttagtctgaccgtccacttcgcatacaaacacgtgcagacgttgttgttcttttgcttctttctcgtagttggtagcaaattcgcccgtattttcggtcagcgtaccgtctacgttcatcagcatatcccctttcacatatttctgatattcagcatccgcatcttccacattcttaatgttcaatgcagcgaggatttgtttcttagtgtccaactgcacattcttgtcttgtgtagatttcagtgaagaactaacgaatgccagcaggaatgctacgataataaccattaccgaagcataaatgatagtataactattactattcgtattcattttctttcggtatttattggttagacttgatagtgcgtttctcgcgacggctgatattgctttgtactacacagtagtcaatcagcggagcgaagatgttcatcagcaggatggcaagcatcataccttccggataacccggattcagtacgcggataacgatagccatcacaccgatcaggaatccgaagatatatttacctctttctgtacgtgcggaagtcacagggtcagtagccataaatacggcaccgaagcagaaaccaccaagaacgagatgttcgtaccaaggcatttgagccattgtgttgttttccatgccgattgagttgaatacccatgccatgaatgcgccaccgacgaatacggaaatcattgtcttccagcttgcaacacctgtccaaagcaggataacggcaccaatcaggatagcgattacgctggtttcaccaatagaacccggaatcagacctgtaatcatatccatgttgaacgcaggaacactacctgttgtagcagcttgtcccagcggagtggcaacggtgagtccgtctacgctttgtcctaaaccgaagatgctgtctcctgacacccaaacagcatcaccggacatcttggtcgggtatgcgaagaacaggaatgcacgagtaatcaacgcaacgttgaatacgttcatacctgtaccaccgaatacttcttttgcgaagataacagagaatgcagtagctacggcaagaatccacagcggacagtctaccggaacgatcatcgggatcaggataccggaaacaaggaatccttcctggatttcttctttcttccattgagctacgacgaactcaatgccaagacctactacgtatgatacgattattttaggcagtactgccaggaatccgtagataaacatttcgatgaagctgccagtagcacctgtatgagtgaaatgctggtaacctacgttgtacataccgaacagcaaagccggtattaacgaaataaccacaatcgacatgatgcgcttgctatcgattgcgtcatgtatgtgcgttcccgttttcgcagtcttgctaggcacgaacaggaatgtttcgaagccgtcaaacaccgactggaatgcgtggaatttgccgccctcctcaaagttcggctttatcttatcgagataatttcttaacgctttcatttatttaattgaaaattgaaagttgagagttgaaaattggctgtgctgggtttatgctgtatccacagagagccgtttcgcaagatttcaactatcgcttattttaatttttattatttaatctcttattcgattacgccatttctgaacggagcatatcgagtccggcacgaacgatgcgttgcagttccatctttgaagagcagacgaattcgcaaagggcgaagtcttcaggagctacttcgtagatgccgagtgcttccatacggtcgatgtcaccagcgataattgctttaatcagatattcgggcagaatgtccattgggaataccttatcgtattcacccgacataatcatgtgacgttcgccacctttgatacgggcatccaacgtatattccttcttacccatcaaccagctgaaataagaacgattggcactgaactggttgaaacgcggcatgatccatccaagcatttcgtgaatgtcgtcaccttcggggataacagtcagttggctatggaatgcgcccaagaatccgttcggagatacttgctttcctgtcagcacgttaccgctgatgtagcgtaagtctttgtcttttgttacattgccggcaaacacgttggtgagcaatgcacctacctgtagtttgcagtatgcaggtttcaacacttcggaacctgtcacagctactgtacgggtgaaatctacatggcctgtattgaagaggcgaccgatgaagattacggcttgcggatcaatagtccataccgtttcgcccttggatacggggtcgaggtggttgatctgaacgcctacattacctgcagggttcggtccgtcgaatgcggtgattgtaacgttcttagcctgtgtcagtgcggcagcgttctgtttcacactgatgttcaagtaggtttttgccagtttggcaagagcatcaagccctgtctggaagtttgcttcttcgcctttgagggcgaactcgaaatccggagccaatggattggtatcgaatgcggagatgaagattcctttcggggttaccgtcggatctgcaatgatgtcataaggacgctgtttgataaacgcgaaaagtccggctcccaacagagcggatttcacagcttcagcatccatcgaagcaacattctttttcccaaaatcttcatagtcctgctctgcagcagcttctactacgatgttcaataccttacgacgagcaccacgttctacactcgtcaccacgccgctcaccggcgaaacaaatttcacttcaggatgatacttgtcgataaacaagggtccaccagccattacatattcctgctctttcacaactaccttaggcgtcactccaggaaagtcatcgggtacaagtgcgtagaatcccggttcttttactgttgcgtacgtttcagcagcttttcctttcaggtttatgtcaaggcctttacgtaactttattacatttgccatgctatataaaataatggtttcataaatttgccgcaaaagtaataaataagattgggattcggtaggaaaaaagaaaggaattacggaaaaatatccgtaattcctttcgtgttcgtgcacgtaatcttttatcttttgttccgaaacaaaagacagaagcaaagaaaaagaactattcagcaaacataggatcccaagcaggaagtcggataggcttctgtttcaacacctcgagagcttttttcgatgcatatttcgtttctactactagacggaacatatattcgttaaaccaatcatctgtcataatgagataaccctgataaccggcagcaggcccccaactattttcaaccatccatttcgtcggttttccatttttgtcaagatcgacggccataagagtcatggcgtgactggagccactggcaaaactttggatacgttgcttcttgttcatgccaaaagaagtacccataagagattcgtagtcgtagtttttgacatccagtagaccacggtcagagtttagaaacttacctacatcgcaagaaaaatacatcattgtgctatccttgagagaagaaatagccatttctttgatatcctcgatggggagattgacatacgtccagtttttgccgtcgtaacggtggcggtcgtagtctatctcataacacttataatattcacggctcggatcgttcattaacatgacataattatcaatcagtttttcgtcaccatactttttcaggaaagaaagtggagtgtaagtttcggtagacacaggctcacccttagcgttatattcagtccaggtaaattcagtaggaggaacaccgagattcaacactaacatgcggtagatggtgctcaacatctctgtttttgttttctcaagggcagcaggcttgacaccttgcgcagcgagatcacggagttgaagcccctgttcacgaagtttcagggcgatcagacctgccatacgggaggtattttcactactgttggtttccggcatcacatctttgggaacaagcccgtatttactgacaatatcggctacaccggtgaatgttccaccgtcactcaaaggattacggaagagccattccaccattttatcatccatcggcttactgctggtatcgataataccttgtagaaagaggttggctttctccagttggtcgaagaagaaaggataagtttgcgagaattcgaaggaaccgaggttatgcttggcgatcgctttggcacgcatcacattcaaacctgtaaaaagccagcaacgaccagaagatttttggtcggtgatacctttagaagacactttgatagaaaaatgcgtatccatgcctttcaggttatcctggttgagagccagtttacggatgtcgttgttgccgatggcgttgcgaatagccttgtcggtgggagtgtttgcataactctgcttgatttgttgcatcatggagtcgctgatgcctcctttcacttcttgcgcttgtgtagaataagaaaaagcacagaaaacaaaaattgataaaatctgtttattcatttgatataaataattaattaataggctgacggatcatgatatgctaacaaatattgttttagtgtatgggattaaatcatgcaattttatttaccagcatatcgaaaaacatcttattctgcaaaaatacgattcttttttagatttattatctaagaacatcaaaactaatcggaataaaatagttttctttgcagtcgaattcctcaaagagaaatatgaagaaatatataataggaatattggtgatgcttccatccatcaatatgatgtcagctacggctgatagtacggcagtaaaaagcgatgaactgcaaatgtctacaacttctatcagtgatactactcctacagattttgaaggcgccccgtcagacaccattcctgccctttccaagcgcgagttgcgtcgccagcgcgtggcaaaccggaatttgcactataacatattaggtggtcccagttatacgccggacttcggtttattagtaggcggtagcgcactgatgacgtttcggatgaatccgagtgataccactcaacggcgttcagtagtgccaatggccatcgccttgatgttcaagggcggcttgaatctgatgacgaaaccacagctcttctttaaaggcgaccgtttccgtatcttcggaaccttctcttataaaaatacaatcgagaatttttatggcatcggatattccactaataaagattatgaacgtggagaagataccagcgagtaccgttatagcggcattcaagtaaacccctggttcttgttccgtctgggagaaagtaatttctttgcaggtcctcaagtcgatttgaactatgacaagataactaaaccggctgcggggatggttaatgagccctcgtacattgcggcaggaggtacggagcacggatacaaaaatttcagttcgggactcggcttcctattgacgtatgacacacgtgatattcccgccaatgcttatagcggaacttaccttgacttccggggaatgatgtacaataaaacgttcggcagtgataataatttttatcgattggaaatcgattaccgccaatacaaaacagtaggacgccgcaaagtgatagcctggacagtgcaaagcaaaaacgcattcggagatgtacccctaacaaaatatgtacttagcgggacccccttcgatcttcgcggttactacatgggacagtttcgcgacaagtcctcgcatgtcatgatggccgaataccgccagatgataaatacggacaaaagcacttgggtaaaaaagatgttaagtcatataggatatgtagcctggggaggatgcggattcatgggacccactccgggcaagatagaaggtgtgcttcccaacctcggattgggattacgtatcgaagttcaaccccgtatgaatgtacgccttgatttcggcagagacatggtgaacaagcagaatttgttctacttcaacatgacagaagccttttgacgccatttacgcgacaaattgtgcacaatttacaagaaagattgtaaaatagataataaaagactgcacataaatgaaattaatccttatatttgcgcaagctataacacagcaagagcaaataataggatttttttatgaagcaatttatatattttttttcggggttattacttctgttcatctctaccacccgtgtagttgcacaagaagtgtctgactattctcaactaagtgaagaagattatagtaaaatagttctccccccactatcagttttattcgaaaatgccaagaacagccccatttatgagatggcggacgtaaaggcgagaattgagcgcaaattactccaaaaagagaaatggtcatttctaggtttcttcagtttacgggggagctatcaatacggaatgttcggtaatgagtccacctatacggacgtggcagtcgccccatatcttacctactccactcaagcgcaaaatggttacacagtaggtgcaggtctaagtattccattgaacgatttattcgacctcaaaggacgtgtcagtcggcaaagactcacactgcggagtgcggaactagaacgagaaatgaagtatgacgaaatcaaaaaaagtattattgaaatgtacacaatggcaatttcgcagatgaaagttcttcaaatgaggagtgaaagtttggtgctagctaatgtgcaatacgaaatttctgaaaagaactttgccaatggtactattgagtctaccgatttatctacagataaggaaaggcaatctcaagcccgtgaggcatatgagaatagcaagttcgaattaacaaagagtttaatgatactcgaagttatttcacgcactcccatcatacgaaaataaaagattaagatatgaactatatcatttctatcatacgagccctatttcgtcatcgctggctgatattgctaggaaccactttcttcacattgctggttatttactacacacgacatatgcaaggaggatatgatgtaaaagccacattatacacaggggtagcttcaggttataatctagaaagtgacaaacgcacagactgggcaacagtacaaaactcaatggacaatttgatcagcatcatgcaggccgaaagtacgttgaagagagtatgtctacgattatttgcgcgaattcttattcagggtaacccggataaagaaaataacggtattaccgcttccagctataactatacctacaatcacttgaaaaatagtccgaatggagctgaaattctaaaactaatcgacaagtcgagtgaagataagacagtagctaatctggaaaaatatatgcgtccacatagagataactatatctatggattattttactacaatcaccctttttatagctataatgccctgaaaaacatcaaagtacagcgtcgattgaccagtgatttgttggatatcagctattcatccggtgatccaggcatcgtctacaatacagtgagtatcttaatggacgaatttgtagaagaatatcgtcgcattcgttatggagagacggacaaagtaatcaaatactttgaagaagagttgaagcgcatcggaaagaaactaaacttagaagaagaagacctaacaaagtataatgtagaaaaacgcattatcaactacattgacgagaccaaagaaatagccgccatcagtaaagaatacgagctgagagagcaagacgcactttttgcttttaatagtagcaaatccatgcttgaagaactagaaaagcatatggacagtaatgcaaaacaggtgctcaagaacatggaatttgtagacaaactgagagaagcttccagcattaccggcagaatatcggaggctgaagcgatgactgtttcctcaaaaacagacgatcagaccttgataaatgaaaagaaacggctctctgaaatcaaacaagaattaaatgacttaacatcctcctatatcggccataaatataccaaagagggcgcttcgagaaccaatatcatcgaccaatggctggaacaaacgctactatacgagaaagccaaagctgaattacagattgtacagaatgcacgcagtgaattgaatgaccgatatgttttttttgcaccggtaggtactaccatcaagcaaaaagagcgcatgataaatttcaccgaacgcaactacctcactgtacttcaaagttataatgaagccttactgagaaagaaaaatctagaaatgacttctgccactttgaaagtactcaacgagccgacttatccgatttcgtccaactcaaccaatcggaaacagattgttatagctgcctgtgcagtcagttttctcatcatagtcgctttgttgttactagtcgaaatgcttgacagaactttacgagatgccagccgtaccaggcgagtcaccgggtttaaggtaataggcgctattcccaatacaagcccctctcgctatggaggtctgaccaagacttatgttcagctttccgtaaaagaattgagcaattcgctacttcgcttcctgactaagcgcaagtctcccggcgtattcatcatcaaccttttcagcaccagtgacaattccggagaagaagaattgggaaatttaatctgtggatatatgcaaagccggatgttaaatgccaggtttatcacctatggagtagattttaatacagactcgacccaatttctgctagccaagagtattacagacttttacactttgcaaggagaagatgtgctgatagttgcttatccgccattatcgaccagcaatattccgagtgctctgttacatgatgccaacgccaatattctagtagcttcggcagaccgtggctggaaaactattgataaacagctttgcgaacaacttacgcagcaactgagtaagacggatgtcccattccgtatatgcctcacaaatgcgaaccgtgacgcagtagaagactttaccggacaacttccaccccatacattactgcgtagaatcggctatcgtctcagtcagttatcattaacagaaaaaatcatattcaatctcagaagaaaagccaaagaagcagcagacgaggacgatgacgaataaagtaaccgctttccacctcctgcttgccgcacagttcgcgctaatcgcagcaagtatgttcgtaaacatcaagataggattattctcaatggtgcttatcttattgtttactacgatctgtctgatacaactcggcaatgacgagcgcactaactggaaacccggacaaaatataatgacctatttcttcattgtctggttattgttttatatactggaaatactgaatccaaacaatgttatggcagcctggaatattaacctcactccatacgctctcacccccttgatctgtgcattcgtcgttccgatcgtaatacgtaccaaaaaagatattgaactattattaattatatggtcaatatttgttttgatattcaccctaaaaggttattggcagaagaatcatggattcagttctaaagatctttatttcttacacgtagtgggaggtgcacgtactcacattatctggtcaggcattcgctatttctcttgtttctctgatgcagccaattatggtgttcatgctgccatgtctactgtgacctttgccattgcctcattctttgttgactccagatggaaacgcatctacttcctttttattgctttttgcggcatttatggaatgggaatctccggaacacgctctgccatgggcgttcttatgggtggcatgctgatgataaccgtcatagcaaagaattggaaagcattactgggaggtatattcatatctatcagcattttcgcatttttctattataccaacatcgggagcggaaaccaatacattcacaaaatgcgttcctctttccatcctaccgaagatgcttcatacctcgtacgtgtcgaaaacaggatgcgaatgaaagaattgatggcaaagaagcctatcggatatggtgttgggctttcaaccggaaatttcgaaccgaaagagcaaatgccctatcctccggattcatggttagtcggcgtatgggtagaaacaggaattgtcggactcattctttatctgggtatacatggcattctattcgcttggtgctcatggctactgatgtttaaagtacgcaataagagcttgcgcggattagtggcagcctggctttgtatggatgccggttatttcatagcggcctatgtcaacgacgtaatgcagtatcccaatccattgactgtatatataggattcgcactctgttttgccgctcctcatatagacaagcgcatcagtgaagaagagaaagaaaaagaactagtagccactcaaaaaaactgacgaacaaatatgacaaacaatattccagacatatcatttatcacaatctgctacaacggattcaaagacacatgcgaactaatagaatcactacagaataaaatacattctgtaagttatgaaatcatcgtcgtagacaatgcttcacatgaaaacgaagcagctaaaatacatcaactgtatcccaccgttgtcgctatccgcagcaatgagaacagtggtttttccggtggaaataatatcggcatccaggtagcaaaaggtaaatacatattccttattaataatgatacatatattgaatcagaccatatcgcctatctcgtagaacgccttgaaagtcgaccggagattggaggtgtatcccccaagatacgctttgcatttccaccccagcatatacaatttgccggattcactcccttgtcgcaaatcaccctacgtaaccatatgctgggcttcgattgtccagacgatggaacattcgacactccccacaccaccccctatctgcatggggcagcaatgatgtttaaacgggaagtcattgaaaaaataggaatgatgcccgagatattttttctctactatgaagaactagactggagcacaagcatgacccgtgccggatatgaactgtggtacgatccctgctgtaccatttttcataaagaaagccagagcactgggcaacttagtaaattgcgtacttattatctgacacgcaaccgcctgttctatgcccggcgcaatctgaaagggttcaaccgcatcgcctccattatttatcagagcaccgtagctgctacaaagaatagtttggctttcatcctcaaagggcgtttcgacttggcggcagccatattctatggagtaaactccggacttcttcgcccgtcatccgacaaaaagagcgttgtctcacccgataaataaaacgttgtgtcataaattccaaatactatgaatatcgtcgactggattctttttgtacttttcgcgctttgcgtatgttatctgttgctatacgccattgcttccaagttctaccgggtccctgaatttccggaagcccgcaccctacgacgtttcgtcatactcttcccggcttataaagaagaccgggtaatcgtctcttccgtacgcagtttcctgagacaggaatatccgaaagaaatgtttgatatcatcgttatctccgaccagatgcagtctgccaccaacgagctcttgcgttccttgcctatccgattgttgatagccgactataaagacagctccaaagccaaagcactgacaatggcaatggatgccattgacggaataccctacgatgtagtagttatcatggacgccgataatctgacttccccgcacttcctgacagcggtaaaccgtgcattcgacagcggtgtgcggtgcatacaagcccaccgaaccggccaaaatctgaatactgacatttctgttctggatggcatcagcgaagaaattaataatggcatcttccgcagcggacacaatgcactaggactttcagccgcattatccggttcaggaatggcttttgaagccgactggttccggaaaaacgtccgacttcttgaaacggcaggcgaagacaaggaattagaagtacttcttctgcaacagcgcattcacaccacctacctaccggaaataccaatttatgacgaaaaaacgcagaaagaagaagccatcagcaatcagcgaaaacgctggatagctgcacaattcggcattctccgcagttcattgtccggattacagaaagcaatccgccaaggtaacattgactactgcgacaagataattcaatggatgctacccccaagactgatccaaatagcaggtgttttcggactgacatttattttcacagccatcggtatctggctaagtctgaaaggcgattccggaaacgaatggatgatagccataaaatggtggatattatccatagcccagatagtagcaatgatattgcccatacctggaaatctgctaaacaaacgattgggtaaagcaattataaaaatcccaatactggcactcactaccatcggcaatttgttcaagttgaaaggagcttataaaaaatttatccatacagaacatggagaaggccatttttaaagaaaattttcttgaaaagcaagagaatatttataaaaaaatgagactccctagaaacaaaaaacttatataaaagagaaaacatcaccaccactaaaaaagaaagaatatgaaaatagccattgaagcacagcgcattttccgccccaacaagcatggaatggattttgttgctcttgaaacaattcgggaactacaaaaaatggatcatgaaaatgaatatttcatttttgtcagtcccggtgaagacaagtgtctggaaagttccgataacgtacatatcatcgagctgaaatgccctacttatccattgtgggaacaggtagcactcccgcgtgcagtaaaaagcatcaagcccgatttgctgcattgcaccagcaacacggctcctctacactgccctgtgcctctggttctaacattgcacgatataatctatctggaaaagcgccagtcgtccagcctgtcgtggtatcaagagatgggatggcattatcgccggttagtcgttccgcgcatactccccaagtgcgagaaaattattaccgtttcgcagttcgaacggaaacggattcttgaagcgttacatctgccggaaaagcaattagtagctgtatataacgggttcaacagtcatttccatttgcagcccaaagctccggaaattacccggaaatatatcgatgcagacgaatatctgttttttctaggaaacacggatccgaaaaagaatactccgagagtactgaaagcgtacagcggatatttgaaaaaatcggcaaagaagttaccattactgattgccgaccttaaagaagatgccattgaccggatattggaagaagaaaagatgatggatatcaaaagttatctcagcttccccggctacattgagaataccgaccttgcagcgctctacagtggtgcattcgcatttctatatccctcacttcgcgaaagtttcggtatcccgatgctggaagcgatggcttgcggaacaccaatcattgcaggaaatacttcagcaatgcccgaaattgcaggtgatggggctttattggttgatccattcagtcccgaagatatcacagcaaaaatcttgaaactagaaaatgacgggacattctaccagcaacaagtggaatacgggcttaagcgcagccagatgttttcgtggagaaacacagcagaatcgttattgagtatatataaggaactttctttatcaaacatctgccccgtgtctaagtaaaactcaccggaaaataacctaagaaatgataaaacgagaaaagacttgtgacaagtatttatgtactcggtcacaagtctttctatagagtacattacatttttgagcagaattctttcacttcgaagcacggacactctttaatccactcttcgggttcgatctctccgtttccgttcaggtccggacttagatcccgatgtccgcacacccggcaaccgggatagtcgcgcaggagtgcaaggatcagcacccgcatcgaatgaatctgccattcggtacgtgtatcggcgggatgaccgtggcagtcaagtccgccctcataacaaatgccaatactgttctggttgtgtccttttgcgtgcgcaccgattcgttcaatctcacgggtggtctttatatctccatttttacggatataaaaatgataccccgtcccgttgaaaccacgccgacggtggcacacttccaaatcatcttccgtaaaatccctgtccgcccttgtggcggaacagtggatcacaatcaagttgatggttcgcataaattcatccctccgtttcagtgaccatctgtactcgttgcacacattccttgctactacactgcagagccgcagcttgcgtcagctgtcctctcaacgagaaaatctccgcgtgcatctctttcactttcgaactaaggtcgaaataatccttcaacactttctccaactgctgcatcagaaaagtatactggtctttcactagttcactgaactctttcacttcttgcgccatcatctggcgcttcttgcggctactgcccagaaaaggcagaatcgtcatgatgatttcgataattttatctaacattttaatagattgagatgataaattaataaattgagaacagagtcaatcaaagcggtttatgctgccggatccggagcttctcctccaccgctaccaccaccgggttctcccccatcgcctttaccatcatcatcggagccgtcaccgccgtttcctccggcagcggacttcttctccgtatacaattcgaacatcatgttattatccccgccacgagtagttgccgtgctgtcattggcaagacgcaatgagttgtcgactttgaaacggagattgatgcgagtgatatttttcaccgtacaatccttttcctgttccacacccggacaggtcagcgtggtataaaaaatacccagtccatccactttcaccttattccctgccacaagcacttttttcatcgcacggacaaaggatttcatcacatgcgacacgtcttccaccgaaagcgacccgatagactcgatttcctgtgccagtgaatcaattgaatagattttcgactctccagccttaggcttgagaagatacatcatcggtgatttatcatcaccgagccgttttctgcgcttgtagcgcacaactgtaactgttgccatatttaaaaattgtttctacgaaaagaagtacattctccctttctgttgatgaaacaaagatacgacaacacattgacgacttaccggattgcaccggactacaccggattatgccggattaaaacggattacaccgaattataccgaaatatgtggaaatatgtaggaatatgtaagattattccctagttttcaatgatccattctccaatagttcgcgtactactgtcgaaattaactcccactttgataactttccgatgatctgcctgataaggaatcgcatactgcttactattgatctgtgccaacgcttcttcaggagtaccgtctactttgaattcaaatacatagatagcctcctgcatctttatcacaacatcagccctgccaacagcgctctttacttctgcatccacatattgccccatcaaccggaacaggaggtagaagatggtctgatagtgtttctcctccttattattcatatcattggggatagaggcgaaaaatgatttgatccgctccatacattgatccagattgccgacccgtaagtctttgataaacgatactacataaaatgtattctcgcgagcaggcaaatgcacataagccggcattaatgattcgataaagcctttccgaacttctttgttaggataagccaacgtatagatctgaaaatcccgatcatattctttaatagtgagataaccgctttggtaaagtaccggaagcgggtctgtaatgacattggtaggtgcatcaaactgctcggcagtagccgaaacgccatccagttgacgaatatcgaaatcgctttgctgcaagatgtctatcaggaaagtgggagtgccggtagagaaccagaaattggcatatttcttttgagcaaatgcattaaacaaactaaacggattgtaaatgtcttcactattttcactgaaatgatacccatcatattgttgtttcaaatgtatacaagcttcatcatacgtttcaccgttcgcctcggccatccttcttatatcttcttccaactgtgtacgcaattcattttccgttataccgcaaatggcactataagcatcttgcatacttatgttctgaagattgttcaattcactaaagatgctcatctgactaaatttactgataccgaccagaaaaagaaaacgaagatattctccctgcgctttcaacggactgaaaaagtcgcgcatgatgccacgtatttcagcttgcaactcctcattgttgttgctatccaacataggagaatcatattcgtctacaagtaacacaacctgacgtccgctctgctcgtaagcacgtttgataatacctttcagacggagactgaaagtgtcttcgctcgtgtcacatccgtaaattcgttcccattccaccaagcgattgttgatagcggagcgcagcatccccgcattcatatacttactgatactgaaatcaatatgcaacacgggataaaccgtccagtctttctccaactgttccatcatcagacccttgaacaggtcttttttaccagagaaataggcttcaagagtggaaactaacagactctttccaaagcgtcggggacggctaagaaaataagtcgtatgtgtatttaccaaacgataaatcaactctgtcttatcaatatacacacaattatcattgcgtagtctctcgaaactctgtatccctatcggataacgcctgaatattccttccatcctttttctatgcttttaacgtgaaacgtaaacaaagatacgataaatttcaagaatcggtattctattagtatcaattcttttatgaatacgcccgaacatccgctctcaaaatttgcctattccactaaaaatgagtaactttacttcaaatataacaatctaaaggcacaactataaatgaaaacaaaaaacaagattctccccgaacaagaagaagaaaaaacattccaataccgcacctatgggaaaggcgagctcgccttgttgtacctccccaatatcctgcaacaaagcgcagtagaccgattcaacgaatggattgaagctgcacccggactaaaagaacggctcctggccaccggcatgaatccacgcagcagatactacactcccgcacaagtaaggctcatcgtcgaagtactccaagaaccctaattgaagtattaagtattaggtatcaagtatggtaaacgcatcgcaacaatggataacatcataatacttaatacttgatacttaatacctaatactttaaaacagctctttttcaggtagccagcaggagttgtcgaacattgtatttcggacacgctggtcagcggagagagaagggtcgtgagattcttcacagggcaggtatcgtccgcttacgggatcgtagacaaaggatgccattccaccgacaccaagatgcttgaatttcaccttgtccacgtatacgcgtgtggcaccaacctccttgtcacgttccacaatgataccgtaatccgctttgttatagaaatcggcagagccgttgatgtcgtacatttccacacgaggggtaatgcccgtgacaggattacggttcattttacgaggatggactacgaccacgagcaggcaattatgttgcacggcaaattctgtaaatttattcaacaggttcgaaatatattgcgtttccgtctgtccaggctgcgggttatggtcgaaacggttgagcgggtcgaagacaatgatgcggcagccacggcggacaacgagttcatgagccttagccagtacacgatccggagaaacattacctttcagagagatatgagagacgttttcagtcagaaaatcttccgagttcgcaaggagtccctccgtcatgccacagccgttttgaaaacggtgtccggtgagtttctcaatcagtttgcggagatgatagacgatgggggtattttccgggctaaagaacccgattttccattgatgccgcaggcagagacgcaacaccaattcgtccacccactcggattttcctgcaccgggaactccggtgacgtagacacttcgcccacgttcatacgtgcagatcttatccatctcctcccatcccgtttccgctccgggaccgaagccgttgtcgaaaagagcccgcagatcgtcatgcaagtcggcagcggtgaagataccttcgagcggaacttctgctgcctgttcgatggcgatacggagactggcgataccatatttgcagagatgctcgttggcatctttacactccggaccgtaagtcaccacccggcagcgttcagctcccagccggttgatgagttcattgcgcaaccggattccggcagaatcagcatcaacggcaatgatgatttcttccaggtcctcgaagtgcgtctccataaaacggtcgagccaggagaggttcgaattggctccggccggcacggagatggcgcttttgaatccggcggcgatggaagaagcagcatccagttccccctcgtggatgatgcaggaggtttgccccaggatggagtcgatgttgtagggaatcagttcggcaccctgcaccattttgaaaagtttcgggagagcgcgaaatttggtgtttatcagttgttccccttcaaaatagttgaagcagatgcaacgttcctttttgccggattgcggcataaattcttcctgttcggtgatgcgtagggcggctatgacggactgcgggatgcaacgcgtctccaccagccaacgctccgtgtcttcggaaagcgtggttttcgaggcatcaaacactggacgctgaaaatgctgcggaatggctgctgcacgacgcttgcgggctgccacacgttcggcattcttgcgctcttccacatcatcgggaacataaaaatcagcgccacaatgataacagtgacagtggcccgtgtcgacgttgacacgtagcgaacggtcgcgcttattcttgcgggtaggaagacattttttacaaatcgtcttgaggactccactcgatttaccgtggatgtcgacatcatagttggcaaaatttctcatatttttttccttttttctaattaaaaaatagtttaaaataatcattcacacgcagaggacttacctgccggacgagtgtctgccacctgccggacgagcttccgttacctgccagacgaacatcaacaacctaccagacgaacatcggcaacctaccggacgaagccagtcatctgccggattaatgcgcccatcttttcttcacatcatcccacacagctgatgcatcgggacgtggcggcgcatcaaccggaataagatgtcccagatacgttcgccgcccgtcgacgacgctttcaaagcggtttacatccttgtcgaccgtattctcaagctctttcagcaaggtttccctcaacgtgcgacaagtaacggaaccggccgcgatataatttgaaaaataccgtttcacgtcctccggaaaaagcagtcccgctcctttgtcataaaggcggatatgttttttgaagatttccaaaataagtttttgatggtctacaaaaagctttcccaaaccggaatgctgcccggccaattccatatatgactggaaagtaaaaagttggtccaccaacttttcccaaggcaacacgggttgtaacgggccatgattgccttcatccgccaaacggctcacaagagacggtgtttctatattactcctattattgtttacaacagaaacacttcctttactctcctcttctttactttcctcttctctcctcttctggttttcagtgggttttctccctttactgacgggcgtttcagcactttttgccacctttttcggacgccctccttttttaccgttttcgatgtccattttccgcttctcttccaagcttttcatcaccctatccaagtaagaagaacgaaacatctgtcgttcctcatccagttcgaagagatcgaattcgcgaagtacccgctccaccgcaacttcatccacatcataccgccgggccatggccttcagtaaaaccggtttgcacgacgcctcataagcatctttagtgcgcagatgcaacagcaacatcacgtaaattccgagtgcttccgcggcattcatctctgacatcatacaggcaatattgtcgtcattcaacaaatttacctccaaattgaaatactgatctttcttcattttcatttatcatttattattccacatttaatacttccggggcgcaaaggtgcaaaatgtattttattccagctatcgcaaaaatgagagagggattatatattttttatccgacctttgccaaaaattattaataatcccaaacaatatggacacaaaacgcaaccaaacgttggaagaaatagaagaaaataaaatagtgaacgagcattaccagaacagagtaatgctgataaaaaagctcttgaaaacgtcacggctagccacagtagacctctgcgtgcatatcgacatcagtgaagcctcctactaccgttacataaatttcaccagctatatgaaagcagacattttcatacatgcttgtctcttcctcaagcaatatattgaaagtcaccacattccttatacccaagaagaaaaacggcttataaaaacattagacctgtttcagatttcctcaaatagcaacttaaactgcaattaaaacacagaaaaggagaaacttatcataagttttattacatttgcaatgtaataaaggtctttaaaacttaaaaaatgagtgatagcgaaacagacagcccatcaataaaagcactgatcgttttcagagaaaacggagaaaccgacaatctatttgttcctatcttatgcgatgctatcagaatggctggaatcaatgtaagatactcccaaaaagaattctgggaatcggatacgacttatgacatcatccatttccaatggccggaagaactggtgggatggacatgcaaagaccccgacgtcatccgccgcctgaaagaacgcattgattttttccgctcgcgaggaactcatttcatatacacacggcacaacattcacccccactatgcaaatgatatcatcagccgggtctacgacataatcgaatcggagagtgacaccgtagtgcacatgggacattacagccagacagaattcatacaaaaatatcccgacagcaggaacgtcatcatcccgtaccacatctaccaatacacctacaaagaagatatcagcatagagcgcgcgcgccaatatctgaacctgccacaagaagcattcgtcgtcaccgccttcgggaaattccgcaaccgggaagaaagacgtatgctgctcggagcgttccgcgactgggacaaagaacggaaactactgatagcccctcgcttatgccccttttcaaggcgcaataactatggcagaaatatcctcaaacgatgggcttcccgaattggctactatgtcctcatgccgttgttaaaccgtatgttcagactacaagcgggagccaacgacgaaccgatagacgagtgcgacctcccttattatatgtctgcctctgacgtgatattcatccaagaaagaaatgcactaaactccgtaaatattcctcttgcttttcttttccacaagatagtcgtaggaccaaataccggcaatataggcgaactattaaaaaacacaggcaatccgactttcaatccgaatcataaagccgatatcatacgggcactgaaaatggcctggcagttatctacttggggaaaaggagaaatgaactatacctatgcactagaaaacatgagtatagataaagtgggcaaacaatatgccgaagtatatagagatttgaacagcagattgtaatgctgctgccagtatcaataatttatcagaatacgaaatgcatgaaatataatgaaataaaagtcagtgtcgtcattcctgtctataacactgaaaaatatgttcgtcaagcagtagaaagcgtgatgtatcaaagcttgaaagaactggaaataatagttgtagatgacggatcaacagacaaaagtttaagtatagtagaaaaactgggtgacactgacaaacgtatacaaatatatacacaagcgaatcagggacaatcaattgcgcgtaacagagggatctcacacgcacacggagaatatatctattttatggatagcgacgatctgctggaagaagatgctttggaattgtgttatcataaatgcaaagaagaaaaacttgattttgtattttttgatgctttagttttctttgaaaacaacgttgaaaatgctccaacactgaattacaaacatacagagaaattagaagacaaaatctataccggccaggaagcacttgaaattcaattacagaataaagaatatactccttccgtttgcctgcactttattcatagaaacgtgatagaaaaacataatctatcattttatcccgaaatcgtacacgaagaccaactgtttactaccttgctttatctacaaagcacgaaagcagcttgcattaaacgaactttttttcatcgtcgtatgagaaaagattctacaatgacgagtaaattcgcaatgcggaacataaaaggatatcttgtcgtcacagaagagattcttagctttagaagacagactaccgaagataaaaataaagaaattattgatttatatttatctcaaatgcttgacgctgccatgtggcaagcacattcactaaaattaccggagcggatcaaactcgcacggttgtgcctgcaaaaatataaaaagtatgtatcgacaaaaacgataggggcattacttttcaaattcctatttataaaccataaaaaaacggtcgacaatggctagcaacattaaaaatcaactcttttcaggagtgttctataccgcactggccaaatacagcggcattgtcatttctcttgtaatagcaggaatactggcccgcctcctatctccggacgacttcggaatcgtagccgttgccaccgtaatcatcgcttttttcagcctcctcaccgatatgggaatatctcccgctatcatacagcacaaatcactgacaaaagatgaactatcaactattttctcgtttaccgtatggaccggcatcggaatcagcatcttgttttttgcagcttcatggatgattgccgactattacgaaagcgaaatcctgcggacactgtgtcaactgctgtccgttaatctattctttgcctccgccaccatcgtgccgggagcactattctatcggaacaaggaattcaaattcatcgctatccgtagtttcgttatccagatttccgcaggtgcggcagccgtgactgccgccctctgcggagcaggattatatgcactgattatcaacccaataatatccagcatactcatattcgtcatctcctaccagcgctatccgcaacgactgcgtttcacgctggggctgacggcgctccggaagatattctcctattccgcctaccagtttctattcaacgtcatcaactacttcagccgcaatctggacaaattactgattggcaaatacatgagtatgtccgacctcggatattacgaaaaatcctatcgcctgatgatgcttcccttgcaaaacatcacccaggtcatcactcctgtaatgcaccccatcttcagtgatttccaaaatgacaaagcaaaactagccacctcttatgaacgtattctccgattcctcgctttcatcggattgcctcttagcgtgctgctcttctttacagcagaggaagtaacgttgattatttttggagtccaatggctgccctccgtacccgtttttcggctactctccctgtccgtaggaattcagatcatactctcctcgtccggttccatctttcaggcggcaggcgatacacggagcttatttgtatgcggagtgttctcgtctgtgctcaacgtgacaggcatactgctcggaatcttctatttcggaacgctgacagcagtggctagttgcattgtggtgacgttctccatcaactttatacaatgttactggcaaatgtaccggataaccttccgtcgaagtgcgtggccattcattcgtcagcttatttctccgttcatcattagcattttgatagcattagccctcattcccatgcagtatgcactggaagggatgaatatttttgtgacaattatagccaaaagtatcgttagttttattatctttggcatttatatacaaatgacgcatgagtatgacattatcggcaaagtgcgaagcatcctgtgtaagagataataaaaagaacagaataaacaatatatagagatttgagcaaccaatgaaagccttattccttatattccacggcttcgacaaagccaacggaattagcaaaaaaatacactatcaggtaaaagccctcaaagaatgtgggttagatgttcgtttatgttattatgacataagcccttccggtgaacgccgctggatggcagacaatgcagtgattgctgaattgggacaaggagtgtttgcgaaaattcggaaacggttgggcctaaactgcatagcaaactacgtacttcgcgaaaatatacattttgtctacatccgttcatatcataatgcaaaccctttcaccataaatatggtgaaacgtatgaagaaaaaaggagcaaaagtggtcatggagataccgacttttccttacgatcaagagtacatcacatggcctatgaaattcaaaaggctcacagatcgttgttttcgtcatcgcctggcctctttccttaatggaatagtcaccttttcaaacgctaaaaatatctttggcgaacgaacaatccgcatatctaacggaattgattttgatgccattcctatgaagaaacaaatgaatgacacgacacatgagctacatttaataggagtagctgaagtacactattggcatggattcgatcgacttatccgtggattagctgaatattattgtacgaatcctgactacaaagtttattttcatatcgtgggaccattatccggcgaacgtgaaaagcaagaaatccttcccgtcattcgtgataataaactagaatcttatgttatcctccatggaccacagcatgatcagcaacttgacgccatgtttgagcaggcagattttgctatcggtagtttaggccgacaccgcagtggtatcacacatatcaaaactttaaaaaatcgcgaatatgctgcacgaggattggcatttacttattcagaaatcgacgaagattttgataagatgccttacatttggaaagcaccaccagatgaatcacctattaatattcaacagttaatcagctttcaaaagtctctgactatgactccgcagaatattagagaatctatccgtccattgtcctggacagcgcaaatgaaaaaagtcatcgatgaattggacatcagaccacagcatacaatacttgaaaagtaatccgatgaataaaaaagtaaaaatagcctattgcatcccctcgctctattatcctagtggaatggaacgtgtacttacactaaaagcaaactattttgcagaacatttagggtatgacatacacatcatattgaccgatggaaaaggaaaagaaccttactataaattgtatccatccatcaccacccatcagctcgacatcaactatgacgaattgtatggcctttccttaccgaaacgaattcaccgatattggagcaaacagaaattgtttaaaaaaaggctggagacatgcctcaatgagattgaaccggacattaccatctctctcttacgacgtgatataaacttcatcaataagatgaaagacaaaagcattaagcttggagaaatccacttcaacaagtccaattaccgggaattcagcgacaactgtcttcctggtatcattcagcgtgccgtcaagcaatactggatgtggcaactcatcaggcaggtgcgacaactcaaaagttttgtcgtccttagccatgaagatgctgccgaatggacagagctcaataatgtaaccgtaatctacaatccactcccgtttttgccggaacaacaatcggataacacccccaaacaggtcattgccgtaggcagatatgtccctcaaaaaggatttgaccgtttaatatctgcttggagcattgtcaataaaaaacacccggactggattctccgtatctatggtgatggtatgcgggaacaacttcagaaccaaatctacgaactaggaattagccccagttgtattctggagcatagcacaccggatattgtcgataagtactgtaaaagttctatcttcgtcctttcttcgcgttatgagggatttggcatggttattatagaagcaatggcatgtggagtacctcccgtctcatttacatgcccctgcggaccgcgtgatatcatcagcgacggaataaacggactattagtagaaaacggtaatatagagggattagcagagaaaatctgctatctgatagaaaacgaaaatgtacgacgagaaatgggacggcaagctcgaatggatatagaacgtttcaggatcgaaccaatcgcagaacaatggaaaacattgtttgaaagtatcattgaaaaaaataaagatttatgaaatggtatactaaatatctgcaagtttacgaacaacctttcgattcagcaccaaaggaagcagtagatttcgtaaaaactaaattgcagaaattatcggaaaacaaacaacccttagcatctgtcattctcatctgctataatgaagaaaagcgtttgctaagttgcttatggtcgctttgtgacaacatctgtgactttccgattgaaattctggctgtcaacaacaattcttccgatcgaactgaaagtgtgctccaacagttgggagtcacttatttcaatgagcttaagaaaggaccgggacatgcccgccaatgcggattaaaccaagcaaaaggaacataccatatctgtattgacaccgataccatgtacccgaacaattacatcaagacacatgtaaaaaaactaatgcaaccaaacgtagtctgcacgttcagcctttggagctttattcctgatgagcaacactctaaatggggattatggtggtatgaatcattaagagacttttacctgcgcattcaagccatacagcgtccggaactttgtgtacgcggcatgacattcgcattcaaaacagaattaggcaagcagttaggattccgcacagatatcattcgtggtgaagacggctcactggctttagcgatgaaaccttacggaaaactcgtctttatccattcttcaaaagcacgggttataaccggatatggaacagtaggagcagatggaggactgtttaaaagcttcaaagtgcgttttatcaaaggattaaaaggtattggaggattattcaccagaaagaaaaaatataaagataaagacaataatttaatcaaataagcaaatgaaaataataagaaaaattattctagttgttatttgtgtaatattagttgactatatataccagtataatcaatttcaaaagtataatcaggctccattaattatcaagactccggaaggtagtaaccaaccctatcacccatcagtaatatacattccggaaggatggaatggatataaatactggatggcggaaactccatatcccttaggtgaggatggtgattggaaaggattgcctccatatagagaacgatgggaaaatccatgtgtgcatgtatctaaagacggaatacattggaacgattttgaggactctcaaaatccaatagatgatttagacgaaaacaatattataaataaagattatttttcagacccacatttagtcttttataaagatactttagagtgctggtaccgcatcagccatcaaaaaaataatgctacttatatattacgcaaatatactctcaatggaaaagactggtctccccgagaggtgatgataaatctacaagatacctctatcataaaaaatgaaacaggtaatatggttataagccctgcgatacataaaggtactaatggatatgtaatgtggtatgtgaacagtatagaaaagccaagagaaatctgtagaagtttttctacagatgggaaaaagtggagcaaaaaagaaacatgtcatctacctgacaattctgttaccccttggcatattgatttagcatatatagacaaaatatattatctagttatatatgattatgatactaataacctagtattatactccagttccgacggcttatcatttaacaacaaaaaatatatattatccaaagctccaatgctgggttctttttattcctatggtttatatcgaagttcacttattaaggacaatgaaaaatataagctatattttagtgcttttgagaaaaaaactgctataggactaatggaaggaaattcaataagtacattacatgctacttctgcagagggaaattttatatctttctgcaaatttccaattgtatatttgaggaataaaaaacagtcgctaaaggaattatttcaatagcatagttgaaaacaaacaatataattatgattggcggcaccttaagcgtatttaaaagtatttgcagacaaaatagtgagatagaaatatgaatataaaattattaatcaaacaatttacattccccttgtcgttaatattactatgctatattaatttacaatacatgcactactcaattcttattgataaatattctcttactccattctcatatctggagaatatcattcatgcttttatcgatatatgcctattattctttattccactttatctaattggaaaaaagacttatttatttttcattccatatactatcattacaatactggtaattgtaaatgtatcttatagtagattcttctacacatatatgcctccaatattatatggagaattcaacaatcttgacggactatcagctaacgtatttgcaactattaggttctctgacattacaatactaataacaactcttgcaagtatcttatcttataaacaatttcatagagcttattctgaaataagaagaaagacacgaagaatcttttccctttacatattaggaattgcatttattttattaggaggattaatagctacagcaacaatacattggtcatcattaaactacaagtatgttcacccttttaaaaatagtccaacagaaagtatattcaaattcggaataatttatgggaccattatacaatgtgcatcaaacaacaaacaagactgtaacccagaggaagtggcaaaactggaaccattcttttacgaatcaaaatatagtattgaatatccaccaaaagaaaatattattctcattatagtagaatcccttctttcgttccctacagatctaaaaataaatggaatagaaattactcctaccctcaacaaattagtagaaaaaggagcatactacaataataacatgacttctctgatacaattaggcgaatcgagcgacggacaattcacatacctcaacggacttatacccaaaacaaaaggtgttaccatttacgattattttaataatactttcgtgtccttgcccaaacttttaaagaaacaaaaacctggaatcgaatgtagaatggttattcctacttcatctaaaacatggagacaagatggagtatgtatccaatatgggtttgataaactctattcacgaaaggaatatacattgagtaattataaagaaaattggttaaatgataagcttctttttgaatatgcagcaagcatagacaaaaatagcaaacaaccttttttctcacttatcctcacatcatcaacgcattctccatataccaaagcagttgaagactacctcattccattccctgacacatattcagaagaattaaaaaattatctatctaatgtgcattatatggataaatacttaggtaagtatttgaatttcttaaaagaaaatcatctttaccacaattctctaattataatagccagtgaccattccatttcaaatgactggcttaaatccaaagaagaagataatgtttcttttcaaatcccattgtatattgtaaactctccacaaaagatcgacaaaacaagcgattatgttatcacgcaagctgatttatttccaacccttcttgatttggggggtattcattctgaatggagaggagtaggaaatagcttactttgccctgattccattttgaacaccgaaagagaaaaaaaacgaataatatatagagaaaaaatttctgatattatattagatagtgattattttaaaggaaagaaaatatctaaataaatacagctatgaacgaaatcatcactctttgtcttgaaataattttctggtttgccttgttcattgtgttctacacatatctgggctacggaattgtgctttacgttctcgtcaagttgaaagaacttttcgtgaagcctgtgaagcgttcgttgccggcatcggacgctggtttgccggaagtgactctcttcattacagcattcaatgaagaagatgttatagacgaaaagatggagaacagtcttgaactggactaccctgcggacaaactgcatatcgtatgggtgacagacggaagcaacgacggtacgaacgaacgactgaaaacccgttggcagggaaaagcgaccatacacttccaacccctacgacagggtaagacagccgcaatgacacgtggaatgacgctggtggacactccgctcgtcgtctttacggatgctaacactatggtaaaccgggaagcaatacaggaaatcgtacttgctttccaagacccgaaagtgggctgcgtggccggcgaaaaacggatcgccgtacagaccaaagacggagccgctgccggtggggaaggtatttactggaaatacgaatcaacactgaaagcacttgacgcccgcctctactctgctgtaggagcagcaggcgaactatttgccgtgcgtcgtgaactattcgaagcaatggaaccggatacgttgctcgatgattttattctttcgctccggatcaccatgaaaggttataccattgcttattgcaccaatgcttacgccatcgaaagcggttcggcagatatgcgcgaagaagaaaagcggaaagtgcgcatcgctgcgggaggattgcagtccatctggcgacttcgtccgttgctgaatcctttccgctacgggacacttagctttcaatatacgtctcaccgggtattgcgatggtctattactccgttcctgttgtttgctctcttcccgctgaatattgcgattctgctgttaggcggttccgcgatattctacggagtgctgcttgccatgcaggttcttttttacggattgggatattggggatattatctatccaccaaacagataaaaaacaagttgctttttatcccctactatttcttatttatgaatgtcaatgtgctgaaaggcatccgttatctgaaaaagaaaaaaggaagcggagcctgggaaaaggcgaaacgcgctgaaaagtaaaacaaatgctattatcttttgttatccttactataagacattagtctctatcatctaataaaaaacagacatgaacagaatattacatgatgcgaataacgcacaaagaatattgaaactgacggcagatacaatgctattggttgacaggcacggagtctgcgtagacattgagcctcattgtgatctatggtttctgcaagaggatatacttttaggaaaaaatatatttgagcttttaccagaatatacgagagagagggtgatgcccatcttccagattgtactcgaagaacaaagaagcatcagcaagaacttcaagttggtgctgaaaggcgaaactttttacttcaaatgcctcatgttcccttatgacggtatggtgctttgccaatatcgcgacatcacgcaaagaagcaacgtaaaaagacagttggaacaggcaaatctcaccctgcgggctatccaaaaggtagcccagataggacaatggacgtacaatacgaaacagaatatttttcattatcttggatataccggtgttttgtgcgaggaaaatgtgcaaaaccttgccattgagaaatatgtggaactgattgtagaagaagaccgtcagagttttatggaatggtgtcgggtgaacgaaaaagaactcaacatggaaagcatcagctaccgtgtccgcctgaacggagaaatcttctatatgcgtatccagacttatctgcgtgaacaacgctccgacggtagtttcaatatcgaaggctatatccagaacatcacggacatacagcatcgtagaaatgacatcaatacactgactcatgccatcaacaacgccaaagaaagtatctttgccgccaagcccgatggcacgattatctttgccaaccgtcgtttcctgtacaatcatggtatttcagaaaacgaagacatcagtcaattaaagatttacaatgtcgccgcagatatgcctacacaagaggcttggaacgaacgttgcaaagatgtcatacacggtggcagcagtaactttgtggctcatcacccatctaaaatcaataaaggtatattggcttatgaaggcacgatgtacaacgtgaccaatgattccggagaagaaagttactggtcgtttgcccatgatatttccgagaggattcggtacgaagcccaaatcaaacggctcaaccaaatcatggatacaaccatcaacaatctccctgccgggattgtagtgaaggaaatcaacaacgacttccgatacatttaccggaatcgggaggcctacaaccgcgatctttataagaacgaccctgtcggcaagaatgacttcgatttctacccgcctatcgtagccgaaaagaagagacaagaagatatccaggtggccaccaccggaaaaggtctgcactggactgctgaaggaaaggacagaaacggaaacatgattatcctcgacaaacggaaaatccgggtggacggtgacgaattgtcttcgcctatcatcgtcagcatcgaatgggacatcacggagctggaaatgataaaacgggaacttcaatcgtcgaaagagaaagcggaaatgtctgatagcctgaagtcggccttcctcgccaatatgagtcatgaaatacgtacgccgctgaatgctatcgtaggtttctcgcatctcattgccgaaagcgacgatgcggaagaacggaagacgtattataacatcgtaaacgcgaacaacgaacgtctcctgcaacttatcaacgagattctcgacctctcgaagattgaatcgggaaccatcgagttttccttcggaccggctagtctccataatctctgccgggaagtgcacgatgctcatatattccgtactccgcagggagtaagccttgtctatgaatcctcggacgaaagtctgatgattgaaacggacaagaaccgggtattccaggtgatttcaaatctgattggaaatgctgtcaagtttacgaaggaaggaagcatcagttatggttacaaactggcggacaatcagattgtattccacgtaacggataccggaacaggaattgaaccggagaaagtggggcgtgtgttcgagcgtttcgcaaagctgaacaatcatgcgcagggtacaggattggggttatctatctgtaagtctattgttgaacggctcggtggaaagatttccgtcaactccgaatttggcaaggggacgacgtttacatttactttaccatacacgattgcaaatcctgcaaatgtggattcttcaaagaaagagaatggtgaagggaacattgctggaatagcatctgccggaaaaactgcagattcgagtgttgacagttctgcaaatacacggcatgcctgtattttggttgccgaagatacggacagtaacttcgacttattggaggctattttaggtaaagatcaccggcttatacgtgcgcatgacggaatggaagctgtcacgatgttcgatgaagtgaaaccggatcttatcttgatggatatcaagatgccgaatctggacggactggaagctacaaaaatcatccgtgaactgtctgccactgttcctattattgctcaaagtgcctttgcatacgaacaggaccggaaagcggctgaagaagcgggatgcaatgattttatagctaaaccaatagcggatgataagttgaaagcaatgattcataaatggttgcttccttcgtagagagcttaatccctcatgatataaccagcaaataatttagattaaatgaaagccttttacagactgttttattacatatccatcgtgctgaccagtattttggcaggagttaccattgcgggtgctttcgtaggcaatgccgcaccggatagtttcaaatttatgcctttcatcggtttgatactgccgatacttttattggctaatcttgcttctgctatctactggacgattcgttggcggtgctgggttttcatccctctgattgctatattcagcaattgggggtatatgagctgtgtattacaatcgccttttttcagtccggcttcgtcaccgatggttaaaatgaatgtatatactccgggggtgttgacggttgctacttacaacgtcgatgcctttaaccacgagcataccggctactcatgcaaggagattgcttcttacatgagaaacctgcaagcagatattctctgttttcaagaatttggcataaacgatgagtttggcatcgatagtatatccgcagctctttctaattggccgtatcattatattccttcttcgcccgaagggaaaaatctgttgcaactggctgttttcagccgttatcctatcaaggaggagcatcttatcatctatcctgattcgaaaaattgcagtcttgcatgtgatattgaaatcaatggtcgcaccatccgcctgttcaacaatcatctccaaacaacggaagtaagccagaacaagcgcaaactggaaaagggacttcgtacggatgattcccaaagagtggaacatgctaccctgggacttatcgacggcttacatgagaatttccggaaacgggccgtacaagctgatcttctcaagcaactgatagccgcctccccctatccaactctagtctgcggtgactttaactctctgccgtcttcgtatgtttatcacactataaaaggtgataagttgcaggatggctttcaaacgagcggacatgggtatatgtatactttcaagtacttcaagcatctgttgagaatcgactatattctccattcaccggaactgaatagcacggattacttctcgccggatcttaattatagcgaccataatccggtggtgatgaggatgaaataaaaaagatgctccgtttattgaacgaagcatctttttatataaatattctagaatgtaaacttaacgcctaactgcatctgccatgcactacctgtagaagcagtataatcccatttagaatttttctggaacacctcgcgagaagatgcattcatctgataagtaagaggttctcctaccttacttgctgtttttaacaaccttacattatcataactctgcaaaccgcaagagcgataagccccccacttcgaatttaataagttaccaatattcaacatatcaagacttacttgaataccgtacttacggctaccaatcttagcataaaaatcctgtgctatcttcatgtcaaaacggtgaatccacggttctaaagaagaagcacgttctacatactgccccttgtgatcattcaaataagagtcattatttacatagttccaaaaatcttcttgttggtctaccgccgaataagtcacattattttgtttatctttaatatccacaaatgtcatttcttctttagaagcaggcacatacatcaaatcggaatagtttccgtcaccgttcatatcattagaataggtataagaaaaacgtccttgttggtaacctgtatagaacaaagaaacagtcgttttcatattcgcataagcaacttcataagaagcattagctatcaaacgatgcggggtagaaaataaagaataagagacacccggatcattcaatgaattaactgcaacattattctgccatactgaagccgccgatgaacctggatttgccgtcatatctttagccattgtataagtgtacccaaatgaacctgtaaagccaaaatcaaatttcttcgttaatactgcattaaaagaatattgataacctttttcatccccattagtcaactgtataacggttttcgtcttaggattgtcatagtaattattcttagtccaatatacacgtcccggttgttcattataggttccagaaggggccttttcgttcatattcttctgaacaacattatatatatcacgtgtatacatagcaccaacagaaagcataaatccataaggtaactgaaactctgcatttacattactacgccaaacttgaggcattttaaaattcggatccacataagctatagcaccggggacctcatttcccggagttgatggaaacatatccggattttgggtaagagtttctttataatttggattaaaagcaaagtttgccggtaattccgaagtctcaaattcaaccatattttgcatctgacctgcatttgtcggttggttagtgaaccatacaaatggtaataaccctgtaaacaagcctgtacctccagtcaaaacaatagaacggtcaccttttatatcccaattaaatcctaaacgaggagatattaacaatttacttttcggccattcggatacgtcaacattcgttccattaaatgactgttctttgatagccgcattccctaacaaatcatcaaaatataacggtaaatcaaagcgtaatccatatgtcaattttaaattaggtgtaatagaatattcatcttgtgcataagctcccaacataccaaatgtcagttcagctcccggagcgtcttttccattatatccataagtaatgccatacagcatcggtttttctcccgtcataaaatcgtccattgaagcataacgataatatccataaggagcacgtaaatatgaattcatgaaatactgtctttcaaatgttgcaccggcagttatcaaatggtttcctttattaatagttacattgtcagtaacactaaatacattattctcgacatcattaaaaggagtaaacaattctgtacccaatgtcatatactgcttaccgtccttgtaaatatcaaccattggaaacgcatctcccttagttgtacgagaatctcggatatgggtataagtcactaataatttgttttgtactgaggaagaaaaattgctattcaactcaccggaaagagacgttacaatatttctaaaaccatagttggaatttccaaatgcaaatgcatcaaccccataacggtttgaattagctttagtgattaccgaagaggttgaactaatactagcatcattttctgatttcactgtgttaaaacgtaatgacagtttatgacttttattaatattccaatccaaacgagccataagcttccaatttttactctcgaaatcatcaaatttatcataacttcccggatcatatccatatttatcctttacaaaatcacttattgtcttcaaatcctttatccaagttctagaaatatgattttgattatccccacttccaccttcttcttgactaggagtccacaaaataccagggctagtactattttctaattctccatttacaaaaaagaatagtttattttttattatcggagctcctaatgtaaagccatacaaactggatttataactttccacattaggaacgtcaacatcgttaatagattttcctataaaattctttggtttctgatatgtataaactgttccctttaattcgtttgtaccactcttggttacagcattaatagaagctcccgtaaaattggaatacgtaacactataaggagaaacattaacgctaatttcatcaattgcatcaagtgaaataggctgcgcatctccacccggcaaattattagtactcaaaccaaaattattgttcaaagctgcaccatccacagttattgtattataacgtccatcacgtccggcaaaagaattactgccacccgcataaggagaaagtttagtaaagtcagtaatactacgattaatagtaggcaatgtcgttaactgacgctcactcacattcgttacagtccccatcttctctactgttttctgtgctgttactataacttcatccaataattcagaactttcctttaaaactacatttaaagtgtatacttctcctaacgataaatttacacctttataaatagcagtctgataaccaacataagaaacttcaactttgtaaggaccaccggtacgcataccttgcaaattaaattgaccactgatattagtcactgtaccataacgtgtacctgacggctcgtggattgcaaccacagtcgctccaatgataggttcatcttgtgctgtaaccttaccactcatactagaagtggtaacctgcgcactaacggtagcaatgaccatgagcatcgccgctactaaaaaagatcgcattctctttaacataaatgtagttgattagttaatataaattgtttgcttttaaaaactgtgcacaaatataattaataatatttagaactacattacgattatactacaattttttaagagagataaacgttttcccttgttataaaacgataaaggctctacaatatttgcagagccttttattttgaaacagaaagcattataaatgcttcaatctattactttatactagtcagtcattaactttctataacgaacgcgttttggttcttcatttcccaaacgtttcattttgttttcttcatattctgaatatgaaccttcgaagtagaatacattggagtctccttcaaaagcaaggatatgtgtacagatacggtcgaggaaccaacggtcgtgcgagataactactgcacagccggcgaaatcttccaaaccttcttccaaagcacgcagagtgtttacgtcgatatcattggtaggctcatcgagcaacagtacattaccttcttctttcaaagccatcgccaagtgtaaacggtttctttcaccaccggacaatacaccgcagagtttttcctgatcgcctccggagaaattgaaacgggaaaggtatgcacgcgcattcacgtcacgtccacccatgcggatcaactcattaccaccggaaattacctgatatacgctcttattcggatcaatatctctgtgttgctggtctacatacgccacctttacagtctctcctacttcaaattctcctttatccactgtttccaatcccataatcaggcggaacaatgtcgtctttcccgcaccattagggccaatcacaccgacaataccattaggaggaagcataaagttcaaatcgtcaaacaacaatttatcaccgtatgctttagccacatgtttggcttcaatgaccttattacccagacggggaccattcggaataaagatttcaagtttctcttctttctccttcacgtcctcattcagcaatttgtcataagagttaagacgtgccttacctttcgcctgacgggctttcggagccatgcgtacccattccaactcacgttccagtgttttacgacgtttgctggcggtcttttcttccatttccatacgtttggtcttttgttccaaccaggaagagtagttacctttccaggggataccttcaccacgatccagttcaagaatccatccggcaacgtgatcgaggaagtaacggtcgtgcgtcacagcaataaccgtaccttcatattgttgtagatgttgttccaaccaatcgatagactctgcatccaagtggttggtaggttcgtccagcaaaagcacatccggtttctgcagcaacaaacggcaaagagctacccggcgacgttcacctccggagagattttctaccggctgatcttcaggcggacaacggagagcatccatcgcacgctccaacttgctatccagattccatgcatcagttgcatcaatgatatcttgcaattcaccctggcgagcaaaaagagcatccatcttatcctgatcctcataatactccggtaaaccaaatttctgattgatctcttcgtattctgtcagtgcgtcaacaatgggttgcacaccttccatcactacttcttttactgtctttgtgttgtctaaataaggttcctgtgccaaataccccacggaatatcccggagaaaacaccacttctccctgaaaggatttctccaaaccggcgatgatcttcaataacgttgatttaccagaaccgttcaaaccgataataccgattttcgctccatagaaaaacgacaggtaaatgtctttcagcacattcttattaggagtgaatgctttgctcactcctaccattgagaagataatttttttatcgtcagcagccataatgtatgattatatattgttgataatggcacaaagataagaaaaatgtttgaattcttttggagttataaaaaaatgttctacctttgcacccgcattcgaaagaaagcactgaaggattgattcgctagctcagcaggtagagcacaacacttttaatgttggggtcctgggttcgagccccaggcggatcacgaaacataaaattaatcccttgataatcagtcgttatcaagggatttttattttaatattcttcacatatacttattctacaagcatagagcgacacggtaattcgattataaaagtagtacctatccccagttgggaatcgactaatatccgcccgttcatcttctcgacgatcagtttgcagataggtaagcccagaccggccccttgagcaaaggaatccaatttctcaaacctttcgaatatcttttcaagcatattctgcgggatgccccgaccggtatctttaacaccgattctgacagattggtggtctacctcatagaagacttccacatgtccggtggtagtgttctttaaggcattcgaaaggaaattactcaagatctgtttgatacgcaatttatccagttctaccaaagaatcatgtgccggatagttggtcagaagttcaacgccggatggtacttgatgagcatactccgctacactctcgtcaagaagctcggtaaggttaacccagtccggacgcaattccagataaccggattctattttagaaagatcaattacatcattaatcagatttaataatagtttgttgttatgtccaatcagagaattatatagttccttttccgctgcattttccgtactagtcaacaggcttgaaaagccgacaatagcatttaaaggagtacggatttcgtgactcatattagccaggaaagcggactttaaccgatcggacgcttcagctttatcacgtgccttgacaagcatttcttctgtccttttcagttctgtgatatcataattgatgctgataatctcgataatccggtcttgcggggcatatttctttactaacagattgacatgcgtccatgtgtatgtgccatcctccctaaggacacgcatctctttgctaagttgggtggtaagtccatttcgtgcgtcgtccagaaaacgaatcaacaaggcacggtcatcggggtggaaatgccggtatgtgccaaagatgtcggacaacggagtttcatacgcttcacccacatttctgtaccaacttttttgagcatagccgtgtccactcaaaatattgaagtgggcataaccgaccttggcataatcaccgaccagttcaaagaactcctcaaactcctgaatcttattataggctaccgttgtttctgtcttatccgcattaatcaatagatagtttatcggttgatgctcactatcatataatgtagtcactttagtcactaaatcaattgtaccctgtttttgggtattctgataatacgaaccaaccttcgagaagtcataacggaaagtaaagtcggcatcttcatttttcttcagccgttctttcatttctttcgggaaaataggattctcaaaaatattgatacccaatacatcttctttcttctctatatgaaacatttctaattccttatcgttcagatccaccaataccccatccatatcgtataattcgataccaataggcaaatacttgaaaatgttagataagagacgctcactgtattgcaaagcttggtaagcagatgctatatcaggaccatcttgcacttcggatataccatagatgacttcgtttccgtcttcatccgtttcttgaaagcataccttgctacgtacccaaacagctcctttcaccgtatcaagcaaatacaccacctccggccgttgatacacaccaaaggaatgaaaagttgcagaatgttgctcctctttcagaatacgtttattgaaatcttcaaaactgataactccggtctgatccagacctaataactctactataaagtcagaacattcataattcgcagttgataaattggctttccaccatcccatattagcgttagccatcaactgcgagaaaaaggtaaaatcttgtagtctattcataacgctatttatcattttattatttttcgggcgcaaaaatacagattggtaacaaatctaactttcagaaagacacttttttagcatattataagaagattatttgtgattaaactaaaaaatttccggttaaaactttctccaaaagagattatttcaaccggaaattttacaatcgtcaagttccttattttactttttcaaggactgataaacagcttttgccatcactttagccccttcttcattcggatggatcttatccggaaacaattggggcattccatccattgctgcgtgaagatcgatgacagacaagttatttttcttggcaaccttctttatcatcggaatgatttgtttagagatgatgtcatcgttgatattatcaccggtctgataggctttagaaggataacaaagataaatcttcggttgagctggcaacgctttgaaagcgtcgaccatcgtttgcagatctttcgtgaagtcggccttatatttccagttgaatgatttactgtcattcgtacccaacttgataacaacgatattaggattgaaagccagcgcatcctgataagccttttcattcatataaggatgatcgcccttgttcagcagagtgcgggcactgactccgaagttctttacccaataagcctctcccaacatacggctcaacacggccggataactgtcacgatcacgattcttgatacgtgctccatacgtaatactatttccaatgcaagctacacggatagcatctttatgaggtactttgaaactacggagccaagacgtcagttcgtccaacatttcattcttatagaggaaaccctcgcgaattccccatccatgtccaccggaaggataaatatgaagcactgaaggaacattgttcttgttcagcgccaaataataattaactccgttagcaggcggaacgactttatcatcatcactatatacgataaaagcacgtggtgtatctttcgtcacttgcttttcattagaatattcaagttccaattcagcagaagcatcttttcccaaaaggttgtcgtgagagcccctatgggtataagatttatccatcgtaatcacaggatagaaaagaatctgaaagttcggacgaagttcgggcttggcatgagtggcaatggtagaagccagatgtccaccggcagaagagcccatgataccaatgtcattcgggttcaaattccagacatcagcactgtcacgtaccaatttcattgctgcttcagcatccgaaatgggtaatgtacgatcaccgttcggcatccggtattttagcacaatcaatgcaataccttgtttattaaagtagggagcccaatcacagccttcgtgttcgaatgccaaatgtgaatatccacctcccggacacgcaaccacagcacgccccgttgccagttccggcgcaggaaggaatacgcgaagtgaaggttgttcaatatcaaaaggtttcggagcattttgcgctaccactcgtgaaccagcaaaaaagagaagcagcaagataaaaatagtagaaaatttctgtttcatagtatctatgtactttgattaatgaataattagatgcgcgaagatagtaattttgcgtatctttgcaccccattttgattagaaaaattatatgcaaggaataaagaatctgacacaaggccctatcaatcgtcaactgtttaatctggcaatgccgatcatggcaacgtcgtttatccaaatggcatatagcctcacagatatggcgtgggtaggacgactgggaagtgaagccgtagccgccatcggttctgtcggaatcctgacctggatgtccggttctatctccttattaaataaggtgggatctgaagtgagtgtcggacaatccatcggtgcgcaaagccaggaagatgcccgcagtttcgcgtctcataacatcacgattgctttgattatttccatctgttggggcacactcctttttatatttgcagaacctatcatacgcatctatgaactcgaagatcatattacggccaatgccatccaatatctgcggattgtttctaccggattgccttttattttcctctccgccgccttcaccggaatttataatgcggcagggcgcagtaaagtcccgttctttatcagcggcacaggattgatactgaacatcattctggacccgctcttcattttcggtttcgggctgggaaccaatggtgcggcatacgctacctggattgcggaagcaagtgttttcctaattttcgtctatcagttgcgttgccgggatgctctgcttggcggtttccctttcttcacgcggctaaagaaaaaatatacacggagaatctttaaactgggattgcccgtagctactttgaatacgctatttgctttcgtcaatatgttcctttgccgcaccgcctcggaacagggaggacacatcggactgatgactttcactaccggagggcaaattgaagcaatcacctggaatacctcacagggattttccaccgcactaagtgccttcatcgcccaaaactacgccgccggacgagtggaacgggtacttagagcctggtatacgactttatggatgacgggaatcttcggtacattctgcacattactattcgttttcttcgggaatgaagtttttgccatattcgtccccgaacaggcggcctacgaagccggaggtgtgttcctccgtatcgacggatattcgcaactttttatgatgctcgaaatcaccatgcagggagtattctacggcatcggacgcaccatccctcctgccattatcagcatcagctgcaactatatgcgtattccgcttgccatcctgtttgtacggatgggcatgggagtggaaggaatctggtgggcagtctgcatcaccacggttgccaaagggttaattcttttgagttggttcattattattaaaaagaagtgtttgagtattccttcaacgataaaaggataattatcatttccctttattaacaaacaaaggggctcgtccgagttattttaacttaaaaagtacacgcttgccaaataatatgtatctttgcattgttattaataatgcgaagtgattcgtataaaaacattttttataaaccaattaaaaaacatcaacattatgaacaagatgaaatttatggttctcttcatgagtattgccatgatatttggtagctgtggaagtatgaacaacactggtaaaggtgctgctatcggtggtggttcgggtgctgcactaggtgcgatcctgggaggtgttatcggtaaaggtaaaggtgctgctatcggtgctgctattggtacggcagtaggtgcaggtacaggtgctcttatcggtaagaagatggacaaagcagcagcagaagcaaaacaaattgaaggcgcacaagtagaacagataacagacaacaacggattgcaagccgtgaaagtaacattcgattcgggtattcttttcactaccggtaatgcaaatctaagtgctgctgctaaatctgctttaagcaagtttgccaacaatgtgctcaaccagaaccgggatatggacgtgtctatctacggatataccgacaaccagggctggaagaacagtactgctgcacaaagccagcaaaagaacctgaacttatcacaagaacgtgcgcaaagtgtgtccagttacttgttgagttgcggtgtttccaccaatcagatcaagagtgtacagggaatgggtgaaagcgatcccgttgcaagcaatgacactgctgccggtcgcgaacaaaaccgtcgtgtagaagtatacatgtacgcaagtgaacaaatgattaaagatgcacaagcagccgctaattaaaaaattactgcgctatacgcgcaacctgctgattttcttctttgcatcaacactactagcagtgattatttaccgtttcatgccggtttatgtaactccgttgatggttatccgaagcgttcagcaagttttttcaggagataaacccacgtggaagcacacgtgggtttcttttgataagatatctcccaacctgccgatggcggtcatagcctccgaagacaaccgttttgccgaacacaacgggttcgacttcgtagaaatcaaaaaagcgatgaaagaaaacgaaacacgcaaacggaaacggggagcaagcaccatcagtcagcagacagccaagaatgtattcttatggccgcaatcttcgtgggtacgcaaagggttcgaagtctattttacgtttctcatcgaactcttctggtcgaaagagcgaatcatggaagtctatctcaactctatagaaatgggaaatggcatctacggcgcacaagcaaccgcaaaaaataagttcggaacaacagccgacaaactgacccggggacaatgtgcactcatcgccgccaccctccccaacccgatacgatttaactcggcgaaaccttcgtcatacatactaaaacgacaaagtcagatattacggctaatgaatctggttcctaaattcccaccggaagagaaggccgttgaaaagaaaaaaagcaaaaaaaagaaaagcaaataacaagaaagaatttataacctagtttaatttacgattagacgaataggtgatttacgattagacaatttacgatgtacgattgaaataacttttggaattataagtacttatctttgcataagtatctcctcattcacaattcaaatttcaatcgtacatcgtaaatcgtttaatcgtaaataaaattaggttataaaaaaggaaggagcaatgagaatctatctctttgctccttctgctaataagcttgtttgtatgcgctatcctcatttatacaaaatctttcaattcctgttgtaaacgttgacgtgtgaagaatatgcggctcttcactgtgcctaatggtaatcctaatttctctgcgatttcgcggtatttaaaaccagatacgtgcatagagaaaggaatcttatactcccgggggagtgcgttgacgatgcggtgcatttctttcaggtcgtaagcaccttccgtactttcaaatcctgaatcttgtggcagatttaagtgataataattatcggttgtgtcaacaaaagtttgatcgcgtactattttacggtagttatttataaagatgttacgcatgatagtgtacatccatcctttgaaatttgtatccggaacatatttctcctcattgtctaatgcttttaaagatgtttcctgcaataagtcatttgcttcttcacggttggccgtcaatttataagcaaaacgaagcaactcttcctgtactccaattaaatcttttctgaaacttaaacttttcatactttaatggttttatggttaatattcgtttttctcgatgtttgcaagtttaaaggtattttgcttatcaagcagggtagaatccgttattttttagggggacattctatcaaatgacagatttcaggtgctttctgatagtttttaggtggtatttgcgaaatttatcccctactgcttggttaaaagaaccaaatagattacttttgattttatattattaaataaaacaaaaagctatgaccatacttattattgtagggattattgtattgctgggcatcatttttgcttccatgtacaactcattagtgaaattgagaaacaatcgtgaaaacgcgttcgccgacatcgatgtacaattgaaacaacgccatgatctcattccccaactggtagacaccgtgaaaggatatgccgcacacgaaaaggaaacgctcgaacgggtgattcaggcacgtaacggtgcagtgggcgcaaaaacgattgatgataagatagctgccgaaaaccagttaagctctgctcttgcaggattgaaaatcactctcgaggcttatcccgatttgaaagctaatcagaatttcctgcaattacaggaagaaattgctgatgtagagaataaactggctgctgtccgccgttacttcaactcggcaactaaagaatataataacgccgtacagacattcccatcgaatatagtagcaggaatgaccggattccaaagagaaatcatgttcgacctggggaagaatgaacgtgcgaatctggatcaggcacctaaaataagtttctaaactctttattcacaccgtccactcaattacaaaagttgaacacgcatgcaatacgtcggaatccaaacacagcagagccggaataatctgcgctctgcgtttctactgttcctgtttccctgtctcgtggcagcactcctctatttatcctgctacctgttggttctttttggatacggaaagagtatggaaatagaaataatgccaatggtcaatcatttcttcctctcttcgttgccatacaccatggggatcgtaatcatctggtttctgattgcctactgggccaacacaagcattatcaattctgccaccggttccaaaccgctggatcgtatagagaataaacgcgtttacaacctggtagaaaacctatgtatgtcgcaaggcatgaagatgccgaaaatcaatatcatctatgacagttctctgaatgcatttgcaagcggtatcaatgaacgtacatacactgttaccctctcggaaggtatcatcaaaaaactgaatgatgaagaactggaagcagtgattgcgcatgagctaagtcatatccgcaatcgtgacgtgcgcttgctgataatatccatcgtctttgtcggtatcttttccatgctgacagaaatcacattatataccatcacgcacatacgtgtacgcagcaacagcaaaggtagtggcggcatttttcttttcattctactcgctttagtgatagctgccatcggttatcttttctcaagcctgatgcgttttgccatttcacgcaaacgcgaatacatggcagacgcgggatcggcagaaatgacgaagaatccgttggcactggccagtgctctccgcaaaatatcggcagatcctgccatcgaggcagtagaaaggaaagacgtggcgcaattatttatacagaatcctaaaaagaaatcgaaaagtatattcagcggaatcaacggattgtttgccactcatcctcccattgaaaaacgaattgaaatactggaacagttctaaaagcctgttctaattttcttcccaagcgtttttattcaaaagttgattatgcccttaattggtctaaacttataaataacagggatttctgtttaattttcattaaaggaaacagaactatccctgtctttttcttatatttggttgttatacatatatacatcaacctaaatacaactgatatgagaacgaagaaacaaatctttatgctgttactagccttgctagtgggcatccctaccctttcggctcaaagtaaaaaggaaaagaaagaacagaagaaagaagccgtaaagaagctgattgaatctgaaaactacaagatagatgtcaacaccgccatgccgatgcgcggacgctccatccctttgacatcttcctactcactggaaatcagaaacgattcggtcatttcttatctgccttattatggacgagcttacagcatcccctatggcggaggcgacgggctaaattttaaagctgtgctcaaagaatacagtatgaaaatggataagaaaggaaatgccgtcatcgagtttatcgcacgcaatcccgaagacaggtatgaatacagagtcaaagtattccccaatggttcggcaagcattgatgtcaatatgcaaaaccgtcagtccattagttttcagggggagctgtatataaaggaagagaagtaagtaagaaacaaaaacaagtaagagaaacgggctaaataattttgtattattaggtgtggattgcacggattacacggttgttagaatgatgattaccatacagcaaccgtgtaatccgtgcctaattttataatataaactattaattcttagctatccgatagaaacaatatgaacacattcactcgggcaatatcttttttattcttccggctcttccccaccttttaatataggcaggcaaatgtgatattttacagctaagatgcgagtcagaaacacgactgatccgccaatcaactgacaagcgtaggactccatacctgcgagatcgcaaatccaatatgcaataccgcctacgacacaagccattgcgtaaatctcctttcggaagataagaggtatttcattgataaatacgtcacgaatcaccccaccagccgctccagtaatgctacccatgataatcgccacccagaaaggataacccaaagcaatgctcttgcctacacctaccacggtaaacagtgccagaccgatggtatcgaaaatgaagaaagtattattgagccggatgagccagcgtccgaaacagatgacccataacaaagccagtcctgtacaaatcagatagatagggtcagtcatccatcccggtgtcacgtcgagcagtacatcacggatggtaccgccgccgatagccgtagcaagtcctaccacataagcgccgaaccagtcgaaacgtttcgccgaagctagccggataccactaatagcaaaggcaaatgtgcctataaaatcaagaatttgaacgaatgtgggcatatatttgttattttgtatgcaaagtaacgaataaattccgtaagaaaatgtacttttgcttcacgaattaaaccgaataaggtagaaacaatatgaaaataacaattgttgcgggggcacgccccaattttatgaagatagctcccattacacgcgctattgaagccgcacgggcgctgggtaaaagtatctcttaccgactggtttatacagggaggaaagatgatacaagtctggatgcttctctcttttcggatctcgatatgaaagctcccgatgtgtatctgggagtggaaagcagtaatccaacgagtttgacagccggaatcatggtagccttcgaacaagaactgacggagaatccggcacacgtagtccttgtggtagacgacttgaccgcaaccatgagttgtgccatcgttgccaagaaacaaggcatcaaggtagcacatctcgtagccggaacccgttctttcgatatgaaaatgccgaaagaagtcaaccgcatgattacagacggactatccgactatctgttcacagccggtatggttgccaaccgcaacctgaaccagacgggaacggaaagcgaaaacgtatattatgtaggcaacattctgattgatgccatccgctacaaccggaaccgcttgctcaaaccgatatggttctccgtcttgggactgcaagaaggaaattatctcctatttactctcaaccgtcgtgtattactcggcaataaggagaatctgcgtcagttgatgaaaacaatcatcgacaagtctgccggtatgcctatcgttgcaccgctgcacacctacgtgcgcaatgccatcaaagagttggacatcgaagctccgaatctccatatcatgccgccgcagaactacctgttcttcggttatctgataaacaaggcgaaaggaatcataacagattcaggaaacgtagccgaagaagcgaccttcctgggtattccttgtatcacactcaacacgtatgccgaacatccggaaacgtggcgcatgggaaccaacgaacttgtcggagaagatcctgccctgcttgccaaaaccatggatacactgatgtacggtgaatggaaacgtggcgaacttcccgaacgttgggacggacgtaccgcagagcgtattgtacagatacttacgagcaaataacatttacccggcatgttccattccgtttcccggcatggaactgttagtttcacgccttgaaactaatagtttcacaccgagaaacaaagtgtttcacaccgagaaaccaacagtttcatgccgggaaacaaaaagtttcaaaggttgaaacaaaaagtgccctacaacgggagcaaaggtttcaaataccgaaactgggagaacgaaatgcggaaatgcccttatcaaaaggattaacagcgggatgttccttgaattatcggacgatatatgcttgtaaacaaccaaaaacgatgggtaaaaaaagttatatattctgttatccttagagttatttgttaactttgcagccctactacgaacgttatgatacaacgatataacaaaatacttatactgttcttactcgtattggtagcttccaatgcttttgcgcagcaaattaaaggggtagtcactgattcgattacccacgagccattgatgtatatctctgtttactatcaggagaagagagatatgggaaccatcaccaatattgacggagaatacagtcttgacacccgcagaaacggagggacactggtgttctccgctgtaggttatatcagtaaaacggttcgggttggttccaacaatcagacagtgaacgttaagttagctccggataatgtgctcctgaacgaggttgtcgtgaaacctcaaaaggagaaatactcccgcaagaacaatccggcagtggaattcatgaagaaggtaatcgaacacaaaaaggcacaagtcctcgaagtgaacgagtactatcagtacgacaagtacgagaagatgaaaatgtctatcaacgacctcacaccggaaaagcttgaaaaaggtatctacaaaaaatattcattcttaagagaccaagtggaagtgtcggaaacaaccaataagttgattctccctatttccgtacaggaaacgtcctcgcaaaccatctaccgcaaaaatcccgaaaacaagaaaacgattatcaaaggaaagaactccaatggtatagaagaatttttctctacgggagatatgctcggcaccgtattgaaagacgtatttgccgacatcaatatctacgatgatgatatccggttgcttcagcagcgtttcgtcagtccgatcggtaacaatgccatctcattttataaatattatctgatggatacattgatggtaaacaaacgcgaatgtgtccacctcacttttgttccgcaaaactcgcaagacttcggattcaccggacatctgtatgtattgaatgattctacatacgccgttcagaaatgtacaatgaacctgcctaaaaagaccggagtcaactttgtcaaccgcatggacatcacgcaacagtatgagcaactgcccaacggcaactgggtgttggcggatgatgacatgaccgtagacctttcctggaattccaacaaaacagcaggtggattgcaggtggaacgaaccacgaaatatagtaattataaattcgatcctattgaacaacgactgttccggttgaaaggcagcgtgataaaagaagcggatatgctctcgaaaagcgatgagtactgggcgagtgtccgtcaagtaccattgacaaagaaagaaagttcgatggatgtattcgtcaaccgtcttgaacagattccgggattcaaatacatcatcttcggagcgaaagcactgattgagaactttgtagagacaggaagcaaagagcatccgagcaaagtggacatcggccctatcaacaccatgatttcgagcaattacattgatggcacccgtttccggttgagcggtatgactacggctcatttcgacaagcactggttcttgagcggatacggagcatacggtctgaaagacgaacgctggaaatatagcggaacggtgacttattcgttcaacaaacgcgattatgtggtttgggagttcccgaaacattatctttcggcaacgtacagttatgacgtaatgtctccgatggacaaattcctgtttacggataaagataatatcttcctgtcggtcaagacaacgacagtagaccaaatgtcgtatatgcgcgacgccaccattaattatgaactcgaaacgctgaccggattcggagtgaaagccatgctgcgccaccgtaacgacgagcctaccggcaaactggaatacctgcgcaatgatgccgcacaaacccgtgtgcacgatgtcacgacttccgaagcaagtctgacgctgcgctatgcgccgggcgaatcatttgtcaactccaagcaacgccgcgtgcctgtgtcgctggacgctcctatctttacgctcactcatgctatgggtttcaaaggagtattgggcggggattataactttaaccgcacggaagcaagtgtgtggaaacgtttctggctcccggcttcctggggaaagattgattgcagcgtgaaagcaggtgcagaatggaacacagttcctttcccgttgttaatcctgccggaagccaacttgtcctacatcacccagcgcgaaacgttcaacttgattaataacatggaattcctgaacgaccgttacgcttccatgtcattatcctacgacatgaatggaaaactcttcaaccgtattcctcttatcaagaacctgaaatggagggaaatgttccgtgtacgtgctctgtggggaacattgacggacaagaacaatccgttcaagagcaacaatcccgatttgttccgtttcccgacacgcgacggtaagttcaccagtttcgtgatggacccgaaagtgccgtatgtcgaagcaagtgtaggtatctacaacattttcaagttgctgcacgttgagtatgtacatcgtttcacttatcgtgataatccgggtatcaacaaaaacggtatccgcttcatggtattaatggtattctaaaaaattatgcaaccactagcagaacggttacggccaaagactttggatgattatatcggtcagaaacatttagttggaccgggggctatcttgcggaaaatgattgacgcaggacgcatctcttcgtttattctctggggacctcccggagtgggtaaaacaacccttgcgcaaatcattgccaacaaactggaaacccctttctatacgttaagtgccgtgacttccggtgtgaaggatgtgcgcgaagtgatagaacgtgccaagagcaaccgcttcttttcacagtccagcccaattctgtttatcgatgaaatccatcggttcagcaagtcgcagcaggattctctgttgggagcggtagagaacggaacagtcacgctgattggcgcaacaacggagaatccgtcgtttgaggtcatccgccctctcctgtcccgctgccagctttatgtgctcaaatctttggagaaagaagatttattggaacttctgcaacgtgccatcaccacggatgccgtattgaaagaacgcaaaattgaattgaaagaaacaacggccatattgcgtttctccggtggagacgcccgcaagctgcttaatatattggaactcgttgtgcaatcggaaacggaagagactgttgtcatcaccgatgaaatggtgaccgaacggttgcaacaaaatccgctggcatacgacaaggatggagagatgcattatgacattatctccgctttcatcaagtctattcgtggcagtgatcctgatggagcgatctattggctggcccgtatggtggaaggaggagaagatcctgctttcattgcccgccgactggtgatttcggctgccgaggacattggtttggcaaacccgaacgcactgcttctcgctaacgcctgctttgaaacattgatgaaaatcggctggcccgaaggacggattcctttagctgaaacaacgatttatctggctaccagtccgaagagtaattcggcatacagcgcgatcaatgacgcactggagttagtccgttcaaccggcaatctgcctgtccccttgcatctgcgcaatgctccgaccaaactgatgaagcaactgggctacggacaggaatataaatatgcacacagctatgaaggtaactttgtcaaacagcaattccttccggacgaactgaaagacaaacggatatggcaaccgcaaaacaatccggcagagcagaagcatgccgaacggatgatacagttgtggggagacaaattcaaaaaatgatatttttcaggcacagattacgcagatgctttattttttagaaaacgtgaaatccgtataatccgtgcctataatatcaatatgttgttaagaaaacacgtataacttattattaatattgaaattgaaatgaagattgtagttttagacggctttgccgccaatcccggagatttatcctgggaaggtatgaaagttcttggagaatgtacaatttatgatcgtacagctccggaagaggtattagaacgtgcagccggtgcagaagcaattctgactaacaaggtaatcatcaatgcagaccacatggctgcactgcccgaactgaaatatatcggtgtattggctaccggatacaacgtggtagacacagctgctgccaaagaacggggaatcgtcgttactaatattccttcatacagcaccgcttccgttgctcaaatggtattttcgcatatcctgaacatcactcaacaagtgcaacaccactccgaagaagtgcacaaaggccgttggacaaacaacaaggatttctgtttttgggacactccgttgatggaacttcgggataagaaaatcggtctggtaggattgggaaacaccggatataccacagcgcgtgttgctatcggattcggtatgcaagtgtacgcattgacttctaaatctcacttccagttaccaccggaaatcaagaaaatggatttggatcaattgttcagcgagtgtgatattatcagtttgcactgcccgcttacaccggatacacgcgaaatggtgaatgcacgccgtcttgccatgatgaagccgacagccatcttaatcaataccggtcgcggaccgcttatcaacgaacaagatcttgcagatgctttgaacagcggtaagatttatgcagccggcgtagacgtgctttctaccgaaccgccttgtgccgacaatccattgctgacagcaaagaactgctacatcactccgcacattgcctgggcaaccatagaggctcgtgaacgtctgatgaatattgcaatcagcaatcttcaggcttacatttctggcaaaccggagaatgtagtcaataaataattaacattagtgtaattcataatgagggtatcataatgcccgaattgaaagatttacctctgctacacattgaaactgaactgcaccctaaaagttagtcacaaaactttaggtgtgcagtttaagttatgtgtggcagggggatttttctaaagaaaagtgtttaggcacaccgctgactataatatataaaaagctccccttattttatctctctaccatgacttagagtgatgttaaataaggggagtttatttgttccgactagaatctctatttcgaaattctatatggacaatgtatgagtgtatggacaaaattattagtacacagacacaagactaatatacaaataatatattagtatgagtgtcctccttcatccatttctttctcggtaatcttatgccggtcgatactacgccaagcgtagaaaatataagcaatcacaaacggaacaagaatggaaacataagccattgtcttcagtgtaaattcactggagcagctattggctaatgtcaatgagctttgcaggtcggtatatgacggataataggcagtattgttgtaccctgctaccagtagcaaagataaaacagtcagtaccgtaccgattcctgcaaaccagatacctttatcaaaagtctttttaagcaatgtctttccgataccgaaaagaaccagtaccaccccaatcaggaataaagccagcactaccggcatctcgataaagtttgtgagatacttgtatggctgcatataaatctcctgtgtttccgggttaacggcaaagccttcggacaccaatgtacgaatgacaaacgacaaaaagaatacaaggaacaagactgtgttattgcgtactgcacgacgacatttgtcggtcagttctttgtcatcaatattattaatgaaatagagtgctcccaatacacgagcaaggaagaagacagccaatccaagaattacattccagatattcgtcaacgcatccaatccgtgccagccatttccccaatgactgattaccggcataatagtgtctgtcatattggccttattaatatagaaatcagaaccggtgaagaaagtagccaccgccccgccaagtaacacaggacccactaccccattaatcaccaagaaagtctgatatgtctttttacctaacagatttcctgccttactctgaaactcataactgacagcctgcaatacaaaactgaaaagtataatcatccaaagccaataagcaccaccgaaactggtactgtagaacaacgggaaagaagcaaagaaagctcctccaaacgtcaccaacgtagtaaacgtaaactcccacttacgcccggtagaattcaccatcatcttacgatgctcttcggttttacccagacagaacaataatgaattacctccctgcacaaacaataagaacacgagtatggctcccagcaaggaaacgacaagccaccaatattgttgcaaaaatatatacataagtttcaagtattaagtaataagtattaagtattatgcgtccggtcctttcttgatagctttcaccataattccgacacctgcaatcagcatcactgtaaacaggagcaggaagataaagaacgtagtttgcacggagcttacatccagtttggagatagcagccatcgtaggcaacatatcgcggatagcccacggctgacgaccacattcggcaaccacccatccggcttgtccggcgatgtaacccaaaggaattgtcagcagagcaatccagtgcatccagcgcatcttactcaaatcctttttatagataaagaaaagaacgactataaagaacaggatgaaatatccgcccaagattaccattatacggaatgcgtagaagttgagaggaacattcggaaccagttggttcacatctttgatatatccgtagccaaaatagggaatattttcctgcaatacattatatgcaatcttcgcatcctcctcgtgtccggcactctttgctgcacgataggcggccaatgcgccgatagccgttttaccacgttctatcttctcggcagcagagagagccttcgatccgtctttcaactgataccccccttcgataatattcgtaatgcccggaacgtaaccgtccacattacgctcggcaaggaaagaaagcatactcgggatttcaaaacggaagaggaaaggatctttcccatcgttgtaagtcttcttttcaggattcaatactcctattccgaccagaccgacattcgttccgccttcatacagaccttccacagcagccagtttcatcggttgtgtttgggcaatctgataaccggaaccgtcacccgtccaaacagaaagcaacgatgctaccaatccgaagattgcaccaatcttgatgctggccaatgcaaactcacgattacgtttcttcagcaagtaccaacaactgataccgaccacaaaaatagcacccaacacccagccggacaataccgtgtggaagaacttattgactgctacaggcgaggtagccaccgcccaaaaatcaaccatctcattacggacagtgtcaggattgaattccatgcctaccggatgctgcatccatgcgttggcaacgagaatccaccaggcggaaatcgtagctcccaatcccgtcagccaggtggaagtcaagtggaaacgtttacttacttttccccatccgaagaacatgaccgcaataaacgtagcttccataaagaatgccaaaataccttcaatagccaacggagcaccgaagatatcccctacaaaccacgaataattgctccagttcgtaccgaattcaaactccagaatcaaacccgttgccacaccgatggcaaagttaataccgaaaagtttcatccaaaactgggcagtctttttccaaaattcgttgcctgttttataatacagcgtctccatgattcccatcactactgccagtccgagtgtgaggggaacaaaaatccagtggtacatggctgtcatcgcaaattgggctctcgaccaatcgatcagcgaggtgtcaatactttcaatcataatcctatgtagtttaagagttaaaaatcagtagatttatcggggatggcacgttctatcagttcatttcccacgtatgtacctttgtcggcatccgttgggtggtcgccgaggaaatcagggaaaaagaacattttgaggatgaagaacatgacgaataatttcagcaaaataataacccatagggtacgtcctaaggtcatactacggaaaccctccaaatagaagttccagatcgtaagcagtgtattcttcatatgttgacgttataatttgtaatgagtacaaatatacattttttataattaaaacaaacaagtagtcaaaaaagttgcaagatttgtcgtgtttttcttcaaaaacctacctatcgacagaaaaaaatcatttaacggcgaaataacgtcatccgtctatcgtttttgcggcatatataatatgtacgtaccttcgctaacagtaaatcaatagaagtatgaatatgataaatgtaagaagattgacagtgatgacatttcttggagcaggtatgctgtccggcatatctgcccaggtttctccgctgcaagtcgatacgctgaaagaaacgaaaatcccggatcaatgggacttgcagtcatgcatcgactatgcaaaggaacagaacattacaattcgtaagaaccggatcactgcggtcagcacgcagattgatgtgaagacagctaaagctgccatgttccccagtctttcgttttctaccggccaacaggtggtgaatcgtccgtatcaggagacaagtagccgggtgagcggtagcgagattatcagtagcaacagcaaaacgagctacaacggtaattatggactgaatgcttcgtggactctatataatggtaataaacggttgaaaaccatccaacaggagaagttgaataatcagatggccgagctggatgtggcgacttccgaaaataatattcaagagtccatcgctcaagtatatatccagattctttatgcagccgaatctgtgaaagtaaacgaaaacaccctgcaagtttccattgcgcagcgcgaccgaggacaggaacttctgaatgccggaagtattgccaaaagcgacctcgcgcaactggaagcacaggtgagcaccgaccgataccaacttgtcaccgcgcaagccactcttgaagattacaaattgcaactgaaacaactgctcgaactggatggggagaatgaaatgaacatctacctccctgccctgtccgacgaaaatgtgctggctccgctgcctaccaaaagagatgtgtacatcagcgcattgagccttcgtccggagattgaagcaagcaaactgaatgtagaagcttctgaactgggtatcaatatcgccaaatcaagctatttccccaccatcagccttagcgcaggaatcggaaccaaccataccagcggtagcgatttcaccttcggagaacaagtgaagaacggatggaacaactctatcggactgtctgtcagtgtgcctatcttcaataaccgtcaaacgaaaagtgccgtacaaaaagctaaattgcagtacgaaacgagcatgttatccttgcttgacgaacaaaaggcactgtacaaaaccattgaaagcctttggttggatgccaacagcgcgcaacagcgttatgctgccgcaaacgaaaagctgaaaagtacaaaaatcagctatgagttgattagcgaacagtttaatttgggaatgaagaataccgtagaactccttactgaaaagaataatttgctgcaagcacagcaggaacagcttcaggctaaatatatggctatactgaatacgcagttgctgaagttctatcagggagatcaattagctttataaagagtataaaatcagcattataaataagtaaaagcataataaacgaatgaaaacgaaaaagattattctaatcgccgtagtagtcgtcgtggttgtaggagcaggaatatggctctttgccggttcacccgccaaacacaaagtgacgtacgccaccgctactgtcagtaaaggcgatatttcaaattcggtgactgctaccggaacgatcgaaccggtgacggaagtagaagtcggtacgcaggtgtccggtatcatcgacaaaatttacgtagattacaactcggaagtaaccaaaggacagctgattgctgagatggaccgcgtcacattgcaaagtgaactggcctcacagcaggcaacttacgatggtgcgaaagctgaatatgaatatcagaaaaagaattatgaacgcagcaaaggcttgcacgaaaagtcactgattagtgatacggacttcgaacaggcactctacaattatcagaaagcgaaaagcagctatgacagcagtaaggcatcgctcgcgaaagcggaacgtaacctatcttacgctaccattacttcaccgattgacggagtagtcatcagccgtgatgtagaagcaggacaaaccgttgcttccggattcgaaactccgacactattcaccattgctgccgacctgacacagatgcaagtagtagccgacgtagatgaagctgatataggtggtatcatagaaggccaacgtgccagcttcacggtagatgcttatccgaatgatgtattcgaagggatcgttacccaaattcgtttgggcgacgcaagcagtacgagcaacacgagcagcacttcaacagtagtcacttacgaagtagtcatctctgcccctaaccccgacttgaaactgaagccgcgtttgacggctaatgtcacgatctatatccttgacaaaaaagacgtattgtccgttccgaacaaagccttacgattcacaccggaaaaaccgctgatcggtaaaaatgacatcgtgaaagattgcgaaggcgaacataaactttggacgcgcgaaggaactacattcaccgctcatccggtagaagtgggaatcagcaacggcatatccaccgaaattatcagtggtattcccgaagggacaaaggtggtaaccgaagctactataggtgtaatgcccggtgaaaacatgggacctgaaggaaatatggaaaatggcggagaaagaagcccgttcatgccgggccctccgggaagtaagaagaaaaaataattattcaatgtgccaataacgaattggcgcattagcacattatttacaatgaaaaaagtaattgaaatacaaaatatcaaacgtaactttcaggtaggcgacgaaaccgttcacgcattgcggggcgtttcgttcaatatcaatgaaggggagtttgtcaccatcatgggtacttccggttcgggaaaatccacgctgcttaatatattaggctgcctggacaccccgacaagcggagagtatctgctcgacgatattcccgtacgtacgatgagcaagcctcaacgtgcagtactaagaaaccggaagattggattcgtgttccaaagctacaacctgttgcctaaaacaacggcagtggaaaatgtggaactaccgctgatgtataactctgccgtcagtgcttccgaacgtcgccgacgtgccatcgagtctttacaggccgtaggattgggggatcgtctggaacacaaatccaaccagatgtccggcggacagatgcaacgggtagccattgcacgtgccttggtcaacaatccggcagtaattcttgccgacgaagcgaccggaaacctcgatagccgtacttccttcgagatacttgtactgtttcagaaacttcatgcagagggacgtacgattatctttgtgacacataatcccgaactttcgcaatatagcagccggaatatccgtctgcgtgacgggcaggttatcgaggatactgccaatccgaaaattctgtctgccgccgaagcactggcggcattgccgaagaatgacgaggattaattaatgtgataaggagtaatgaagttataagaagcaattcatgtgataaggaacaatgaagttataagatgatatgcttagagcatcacgccaacattttacagtctcataactttataaccttataatagccttataccttcagaacttcattaataactccataactttataaacatgaatggaactaatttatttaagatagctctccgggcattggcgaacaataagctgcgtgcttttctaaccatgctcggtatcattatcggtgttgcttccgtcatcacgatgctggctatcggacaaggttcgaagaaaagcatccagcagcagatttccgagatgggatcgaacatgattatgattcatccgggagccgatatgcggggaggtgtccggcaggacccgtctgcgatgcagactttgaagcttgccgactacgaggccttgcgcgatgagaccagtttcctatctgccatcagtcccaatgtttcgtcatcgggacagcttattgccggtaacaacaactatccggcttcggtgaacggtgtcggaacagaatatctcgatattcgccaactgactgttgagaacggagatatgtttacagaagccgacatacagagttcggccaaagtgtgcgtgattggaaagaccatagtcgacaatctgtttccggacggaagtgatccggttggtaagattatccgtttcaacaaaatacctttccgtgtagtaggagtgctcaaagcaaaagggtacaactctatgggacaagaccaagatgccgtagtgcttgcaccatataccaccgtaatgaaacgtctgcttgccgttacgtatttgcagggagtatttgcctctgccctcaccgaggatatgacggactatgcaactgacgaaatcagtacaatcctccgccgcaaccataaactgaaggcttcggatgatgatgatttcaccatccgcacccaacaggaattgagcacgatgctcaactcaaccaccgatttgatgactaccctgcttgcttgcatcgcaggtatttcgctggtagtgggtggtatcgggattatgaatatcatgtatgtatccgttacggagcgtacccgtgaaatcggtctgcgtatgtctgtcggcgcacgcggggtcgacattctaagtcaattcctcatcgaagccatcatgattagtatcacgggaggtatcatcggagtgattatcggctgcggagccagctggattgtcaagagcgtagcgcattggcctatctatatccagccgtggagcgtattcctctccttcgcagtatgtacagttacaggagtcttcttcggatggtatccggctaagaaagcagcagatttagatccgatagaagccatcagatacgaataaaatggataattaccaataaaagaattatctttgtctttatgaaacaaacctttacatccgcacgtcgtcccctggaagtactgatacacattatcagctgggggattatgttcggtttcccgttcttcttcgtcgaacgtgggaacgggaacatcaactggatggcttatacacgccaccttgccgtaccactctctttcatgattgtgttctacgtaaattatttcattcttgtgccgcgctatcttttccagagtcaggccaaaagatatgtggtctacaatattatctttttatgtgccatcggtgtgttgcttcatctctggcaaagtctgacgttcgatccgtcatttgctcccaaatcaaaaagaccggggatgcctccgggatggttgtttttccttagggatatgttgagtctcgtattcactatcggactaagtgccgctatccgcatgagtgcccgatggacacagaatgaagctgcccgaaaagaggcggaacggaaccgtgcggaagcggaactgaagaacctgcggaaccaactgaacccgcactttctgctgaatacgctgaataacatctatgcattgattgcatttgattcggacaaggcgcaacaggcagttcaggagttgagcaaactgcttcgttatgtgttatatgataaccagcagacatacgttcctctctgtaaggaggtcgattttatccgcaattacatcgaactgatgcgcatccgtctgtccgccaacgtgcagatgattactaaattcgatattcagcccgacagtcagacgctcattgccccgcttatctttatctctttgatagagaacgctttcaaacatggcatctctcctactgaatcgagtttcatcagtattcatattttggagaatgataaggaagtgatttgtgaaatccgcaatagcaatcatcctaagacagtggaggataagagtggctcgggcgtgggattggaacaagtcagccgccggttggagatactttatcccggagcttatacgtggttgaaaggcgtctcaaaagacgaaaaggtatacgaatcgagattgagtatcaagattagagagtagaaagaaaaacgttcagtataaaatgtcaagtaccaatgtttagtataaagcgtcaagtacaagattttggatataaaactttagatataaaatagtatgatgttacgttgcgcaatcgttgacgatgagcctttagctcttagcttgttagagagttatgtgaataagactccgttcctgcaacttgcaggaaagtattccagtgcggttcaggcgatgaaagaattgccgagcgaagagatcgaccttctgtttctggacattcagatgccggagcttaacggtctggagttctcgaagatggtagatccgcatacgcgcattgtatttaccaccgctttcggacagtatgccatcgacggttatcgtgtcaatgcactcgattacctgctaaaaccaatctcatacgttgatttcctgcaagctgccaacaaagctctccaatggttcgaactcgtgcagaaaccggaagagatagatagtatctttgtgaaaagtgactacaaactggtacaagtggacttgaagaaaatcatgtatatcgaaggactgaaagattacatcaaaatatatacggaagacgctcccaaacctatcctgtcactgatgagtatgaaagccatggaagagcttttgccatccagtcgtttcatacgtgtgcaccgctccttcatcgtacagaaagataaaatacgtgtgattgaccgcggacgtatcgtgtttgacaagacatatattcctatcagcgatagttacaagcaagtttttcagacttttcttgacgaaaggagctgattattcattattttatcggtaaaaaagtgatttttgtcgattatagtttgccaaaatccgttttatatctacctttgcaaagaacagaaagggattgtgaaattccaagaatagaatagtttagttaagtctagtttagtttttgtgttgatcggaagcctgcgagcgagcatgagcttccgatttttattttattgatatacagcatattaaaagcacaatcgaactatttttcctatcaattagtagtctataatagagagcaaaaacgtcacttttgacgctataaaatggtcggattatggtcggaaaattcccggattagaatctgattataagtaaattacaataggatgttaaaaaaataatggtcgaaaacgccatttttaccctaaaaacacaaattatggctacattaacattggtaatagttcccgcaaagaagttatcagacgggacacacaaaataagaattcgagtcgcacacaactctgaaacgagattcatcaccacggatatagtggtaagggaaaacgagtttaagaacggtaaaatagtacaccgtccagacaaggattttctcaatacaaaattacaacagctatacaacctttatttcaagcgatacatggaactggactaccctgattcgctcacgtgcacgcaattagtcaaaatgataactaacccgttaaacggagaaaagcatcgtaagttcgaggatatcgtggatgaatatctgtcccaaatagatgaagaagaacgtaccaagacatacaaactctatcggctggccacaaacaagtttatgcaattcatcgggaacggttctctcatggaacatattacccctatcagaatgaaccagtacatatcatggctcaaaaagacaaagctgtcaagcaccacaatcaacatctacataaccctgctaaaggttattatcaactatgccataaagatgaaatacgttacctacgatatcgaccctttcatcacagccaagattccatcaacccaaaagagagaaacccaaattacagtggaagaactcaaaacaatcagagatgcaaatttagagcattacaatctcaacgtaacacgggacattttcatgcttacttattatcttgccggcatgaacctagtagacatactagcatacgatttccggacggatgaaataaactacatccggaaaaagaccaaaaacaccaaagaaggggactccctgatttccttttccattcccgaagaagcaaagcccattataaaaaagtatatgaaaaagaatacagggaaaatcatattcgggaaatacaagaactatacctcctgctataacctgctggccaggaaaatcagtcaattaggcaaggtggcaggaatcaggcataaattcaccctatattcagcccgcaaatctttcgtccaacatggatatgacctgggaattcctcttagtacactggaatactgtatcgggcaatcaatgaaagaagatagaccaatcttcaactatgtcacaataatgagaaaacacgctgataaagcaatcagggaaatacttgacaacttgaaaaatgaataatcacatataaaataaatcactaagaatttgcataataaccaaatgcttattatctttgtagtgtcaaataagagttcttaattttaatgtttaactgatgaaagatgaagaaaaaaaagaattagaacaagagtatgagaatttaaaacttctcgcttcatttcacgaggcctatggggttcctgaaaatgccaaagaacgggaagcgcttataaatgacatactcgatcggatgaacgaaatccaagagaaattaaaaaagttgtaattaacatccctcccttcggggagggacaaacattaaaagctatgatagattggaatgattgcctgccaacaaaagaaatgcaggctgactttgaaagattcaaagaactaaaaaccacagaagaaaaagaagctttcaaaaaggaaatgcaggataaatataataaactaccggaagcccaaaaggaagcctacaaaaaagcatctgaagctgggctaaaagcaacagtaaatgcctgcaatgattatatagaaagagcggaagaagccatattacgtgataaacttggagaattgcccgaagcaatctcattcagttatattgcaaagaaatattttggtaaaagtagaaactggctatatcagcgtattaacgggaatatagtcaacgggaaaaaggctcgctttactgacaatgaactcaaaacgttcctgaacgctttgaacgatgttagcgaaatgattcatcagacatcattaaaaatcagttaagctcttatttgacaccatccctgcattgagccgatgcagggatttttattgtctaatcgaaaaataattgtatctttgcaacatcaagataatacggacataattcggattattttggtttgactttggtgagggggtggttcccctcacttttttatttctaccgaacattctatagtatattattttctggaagaatcacattgtacaatttttccaacaaatcactagacatatattcgtttttgtttgccttttgaaacaagactggtggaaaatgtatatattccattcggcgggatacagattcatcatttatcccctctttcaatcgcacatctttcaactcaaggttattgaacaaatcggcattcaagtataaccttcgtgtctcaattgttgataatgaactaaatgagttaaaaaacaacaacacaagttcatactttgacagttgcgctcgaaatatattcgaatattttaggggcgaagtgaattccgaagtcatttccaaaatataataagcattcctaaaatatgtgccaagttgatttttatatggggcaaaacaatgatcagcggctttagcacaagcttcagctatgggcttgaaattattctgttcaaaatagatcttaatcgcatttaaacagaggtaatcataagtgtttatatgtacaggataaatattaatctttcctttatgtattccaaattcatgctctgaataaatgttgttaatggcagccttcaattgaccatatataagcatccattgctctttagacatattttggggaataatcctccttacaaattcctctttggaaaaattttcaggaatacctcttcttatttccaaatagaaagtatggtataactctacataaatctgtcgataagttttttctggtgtacaaaactcattgtaaggagttattttccattcacattgtttttcatcatatacccaatctattcttttcacttgcaaggcatcccgatatgaaataaaaatcctaagcaactcaaaaagacagctctatcctcgctattcaagaattgctgtttattctgtcttaatgtaaataaaactccgacgaatgctattaatcctgcaatcgctcctaatagacttccaaactcaccccagtcggtctgtttatccgcaaacttacctttggtctgaataaaatagaaagctaaaatgactattataattaatatgaggatgacagttccccaaacgagccaaccttttacatttcttttcattcttatcataaatcaaaatctaataagttttaaaacaatattatcaattcaaatataatcatgattttgataaataaaaaatatttccagaaataatagattccaaaggtactaaagtttgttcctatttatcacagcaaacaatataatataagtgctcaccaattatagctatacttgacttaaaagaaaagtgctcacttttttatatccttaccgaacttttcaattatatattagtactatcttatgtaacccttcttgagagtttgttgattcgtgtgttgttgattggaaggattacaaaaaaggcagcctagtaagctgcctttaattctttctattacctttcggaaccatccttaatttgagagagtgaagcttccaataccccctcaacattttcaatttgaataacttccaaagaaggaacataattatcgacatcaccaataccacttctacttattattcttccttcaaattcttttccgctctccaacgtcaacttgacctccttgcctggttgtagtttttcttctttcataatatttttttttaattaatattagcattccgagcaaaaaatatgccggaacacattttctttgtattccggcacgaaggcacttgtttatacagttgcaaatatatatattatttctcaaatattgtatttttaaccatatatttttaatcaagaattgtattctcaacaaaatggcttctttcttaatccatacgctagccaacagataataatcaaaataattactcctatataaactttatctttatgtaaatcccaccaagataactcgactaccttctctctttgatttagtaaagcattcaccttgttacttatagtatcaagtcgattcgagaactgctgcaaagtaatggataatgtttcatcaacttcactccgttcttgctcctgtttggaagcggtggtagtactttctttgactagatactgttttccggttgaatccggaagcgacaagtaaactgttttattctcaattttcagatcactcaacttgtcagtagtaactttcgtttgcttattcacatccagctgtaatgattcaattaagtttcgcaaatacaaaaaatcccctgaatagtcaatctgcttttgtgactcaatgctatgagaagttttgcaggaagtaaaccatattcctgacatcaggaacatggttatatagattagcattttcatactttcagatatttacaaatacctttcacatgaagagagacaatagtccgtttcccctcctctgacagcaggaaatccacatcttctttgttatcctgaaacagattctccgtcagaacagccggacacttcgtatgcttcaagatataaaaactactctccttatctggatcaccgtctgccatatccttccgtattttcattccaaacaaatattcttcagcagtagcatacagacagtcagccagcttatcggcttttgtctgtcccacactggtccatgcttcccaaccacgtgcttgcatccaatttgaaccattaccggctgcattgcaatggatagaaataagaattgcttcagaagtcttatattcattcactcgcctacaacgttctgacaaaggaacatctatttcctctttcacgaccagttccgcatcaatacctaatttacgcaattcaaatactacacgcccagcaatttcacgggtataagagtattcccttaacctgccatccggagaacacttacccggagtattgctaccgtgaccgttatcaatcaatattttcatatctttcctctttatctagttcgttttcgattctatcaataattccttgtacatgtgtaggcgtagcccgcttaaattcaaaacgtattacatggtaaattatacgaaaccctttgtttctaggataagcaataatcagattcttaaatgcgttctgaagatatacataagaaaatacatacgtaatagtcttaataactaacaatgagttctcaccgtctcctatcaagctcataaaggagaagactacttcaatgattataagatagagaagaagttcaaccaaggcatttttaaacttatcccacttaaagtttttacaacgtataattgaaacaccatcagccctcattccgcaccaaatattaaatccaaacattataactaatgctataagaaaacctttagtcggcgttaaataagcaagaagagaactgaacatcgaaacgaaaataattcgtatctggtctacattaaatagctcatataaccatctcataatattaatcataaagttactaccaatattgaaaacacagtaatcagcccaggaagcaaaacagtagctaatgcgtcaagccaatcaaagatgaacccgcactttttctgaatgtactcaaccactattgcggcaatggcggttgtcgttaaagaaacaatagcagatttacagaaatcaatgcctaatagaaggaaacagaaaacaagcattacaacaaagacgaacatcccggctttggcgtgtgccggtcggttagattgcaaaatccaatcatacaatacttttatacccatactcatagcgtttaattattaataaaatattctgtatggaacaaatgtattgagtataataacgagttttacaaaaacggaaaatcttggaaatcaattctatgataaatatctataaaacaagacattataatttttactttttccataaataaaaaagggatgcttgaaaagcacccctaaaacaaccaacaaattgaactattaatccgtaaacatatacacggaaagatcaaccttttctatttcgtctgaaattgtatctccatacattgttagacacacccgatagcggtcaatacttctttgaatctgttgcaaggtaggtttctcgggatattccgaactggcaaaagttactagttcctcaccattctcattggtaccaaccacccggaagtgatgacgcacaatccaggttccgtccggctgttgctcgataggcttagcaatcccacgcggtaagatatttttttgatccatgttttttgatatgtttaattagttgttttctatggttatatttattcttcaatacaaacttttcaaaatgtccttcgatataaacatattcccaccattcaggaagcaacatcgctgcaattttacggcggatattgtacgttgcaaagtgtttcatcaggccataataagagttcatcgtactcacaaacttctcaacatacgcttctgcaaatccattttcagctattctattaaatttcctgacagcgttatatgtgttaccaaccaccctgttagatacataaattctaccaggcaaaatgaacgcccctacaaacaagactccttttttataatgctgaagatacagtttgcgtggatgcaaccgtaaaaggagttgttctttcaggaaaccatcaagaagatggactttggacaatatttcttccggtgatttcactacgatacaaaagtcatcaacaaagcgtacataatatatgaatcccagtatttccatcacgaaataatcatatacagacgccagaaagttggctatgagttgcgacggcaggttcccgatagccactcccctgtcagggtcattatgaaacagacttttattactgggaagtttgtcccacatggagacgggagagcgtctgatacacttattttgtggacaatgaaagatagtaacggctagaaggtaaagcagacattcaatatcatcgcctttataattgtcccttacgaatatgttcagcatttcccataccaacgatttcgagatagacatgaagaaactaaacaggtcatctttgaaaatgtacgcatcggcagtataattctcactgacctcgactatcatgttattcagatagtgcacggcagacagacatccctcacctttccggcagttcttcgagacgttcccttgttcccgaaaacgttcctctaaaatcggctcgatacgaagagcgatccagtgatggacaacacgatcaatgaaagcggcggcaaaaacctcccgatataccgggtaagtccgtatgaatacttttgaaaagtccggtacatattcaccgtaaataatagaataccatagccgcaccaatgcagactgataatcattataaaactcaacacaatccgtactcgttcttttctgtctggcacaatcttcggatgcttcgaaaatactgctaagaagtatgtcatagattatattacctgttgcggcgaggggacgaacccggttcgcgttctggcggttgttcgtgttgacgttgccgttgttgaagttcacgttccaactgctggaagccgttgcatccgctatcttagtctttcccggctcatcaccggggggatgcccaataaataattctaattgctcactcataatccccttggcgattatgactccggctttgcgacttgttgcgatccgttagctttttgccgttggagatctgcaaccgtttttttgtaccaaccggtactttgcttaccgatgctctctgcaagcagacagatttcggcagtttgagtcaggctggtcaaatgtcgttcttcacacactcttagcagtaatttcaatgcatcaaactcacacaaaaacttcatcagataatctgcacgatgctcaaggttcatatctgtatttgcataacggatatattcgcaacaatgaacggcaagcatcatcaactccgtaccaaattcataccggaacgccttggggaattgttgccgggcatcaatgataaggttcagaagcttatacatcgaatttgatataggaaggtcttgtgtaagtgccatgttaattttttaatattttaatgtatgtattagagggggcaaagttaataactgtaaagcaattaacacaattttagctcaaaaaagtgaagctaaaaagcccctgccggggcttttatttagctaactatctaagggacaaagaattaaagggataaagtgtttattgcggcgaggggacgaacccggtacgcgtactggcggtcgtacgtgtagacgctgccgccgttgaagcccacgtaccaactgctggaagcgtcatattcggtactagaccaataccagtcgtttgtaaatatattttgattgccaaacatagaagttatgagctcattgatttcggttttatacttggccataagcataagttcacccaatgcgggcaggttccacacggttgtatcttcaattccgtcagattcaagcgtacaggctttataggctctggcaacttcggcggcaggggtgccgacagttccctgggtgtccttgacgcctgcaagggtttctattataacatcggtattttccttgccgtcgaaggtatcatagagtccttggttaccactgccgtagtttttcaagccgcgtaggtcagttccgtagccaccccatttgaacgttttattgccgcctgcgtcaacgcagtcgcttttggcgataatgaactggtggcattcggcgcgaagtcggatgccgatacggatatacttggagcgattattcgcgctcatggagttccattcggaagccgtgaaaaagacttgttcaccgtcttcaatccggagcgtagccaaagaaaggtcaagaagcgtacctgaccattgcatatatttggcgatgtcgcttgcgggggtgttttcattcacggttgtaaaacctattgattttaaggcttctatctggtcttgtttattcaagcgcagaagcatggcgctggcgatatttttatccattttattgtataatattaagttaatactattcggaagcaacagctctcacatgaagaagggctgaatttttgttttgattcgtaatacgcccggtattcagttcgaacgcccaggcggagttagtatcccaaattgttgatgaccagtagtatttatcagtcatcagcatactgtcactactccaaaaggtacgcatcatctcattgattttatcgcggtagcggtacatcagaagcatttggccggatgaaggaaggaaccagttggattcatcctcgataccgtcactttccaaagtgtaggcacggtatgcacgggcggcttcggcagccggcgcaccgattacaccgctattgttttggtctttcaggccggtgataatcaggtcggtatcttcctcacccgtgaagcagccgtacatggcacccagtcctttttggttcaggccgtctatggctttaccctgaccgccccaatagaaggtagtagtcatatcggcattatagcactcctgggcggcgattacgaaggagtgtccatgggcacggatacgaagcccacgtttgatatacagttgcttattagcgagcgtaagggagttccattcggcagcagtaaagtatgccttggagttatccgaaatacgattacaggcaagatgcagatcaagcagaccggcggcccacttgatacgttgtccaaattcagatgcgcgggaattctcggtgacatccgagaagcccacggcgttcagtgctgccacttgtgcctgtttattcaagcgaagcagcgttgcgctttgttcattcgtcatagttacttgttaattaaatcattaatatccatattgtcttcagcaaaccgttcgagatattcctcgtaggtttcgccgttataatattcaaggacttcattgatgttgtccagcgttacgttatcgtagtacggttctccgccataagactcattattgaaccagttgatcaggtcgatgtaggcatctatgacggtaaggatgacaaggccgtcaataccggattcaagggattcgatttcatccgtttcacggataactgtcagttcatacgtgccgttgactaccggtttatcctgtctgttgccgtcctcatccattccggcaactccatattcgagaatggcaagaagctcggagccgtcagccttcagggtcatgttcgagatacggagcatggaaagtttacgggatgccgcttgtgaagcgaggacgtcacggagcatctgaatggcgtcaagttgaggcgacgtttcaagacgcaggcgttggacgttcggcatggattcgatttgcaggccggacggggcggaaagaccggtataggtcagttcaggaagaccgacaaaacggaggcttgtcattgttggtggaagagagatgtcgtttatcggagaagtctctgcaagcgtgatgttctccagtttgctaccggacgcattgatatgggcgatacgtgggcatttgtcggtgacgagcgtagcgatttgtgtgttccggatatcgagtgatacgaggaagggcatttcgccgcagttcaacgaggtaagcggtgcgtaagaaccgatggattgttccgtatgggtgtcagagcccaagataagggtttccacaagttgcatggcggagaagctcaccgtacttgacagggagatttcagacaggtcgagcagcttcatgcggtcagcctgatagatatacagcaaggcgccttcctcatgtgagaagttggtgaatacatattcttcgcccgcttcaaggaagcagctttcggaaaggttgccgctagcgtcattgccaacaccgaagtaaccgtttttagcggcgacaatccggatggtggcgtttggtttggaagatacgcgcccggaaattacaccgctgaagaaatcacctgtttggaaatagccgtcacgaatacgccaacgtctttcaatgaaggacggaagggcggtaagtccaagaccttgcagggcatagaagtaaatagcgtcagaggtggctgtataggagatgtatttccgttcaccgtcgtaagaactaaccagtttctgccattttttgagccgtttgtcaatgaagaaatgcgtagctccttcgggtgagaacgggtgcagggtgacgccgtcaatggtcgcctgaacgttacgcatagcggcggcaacagtacgcagggagagttccgtaccggatgagtcagtccacactacttgctggagatagatgttattaaacagaacggagccgtagccagcataagggttagtgaatgtttcatcgctcgtccggttggggtccacctcggcatcaaccgtgcaaccaccgtcgttgtccttgctgttgagcgtatcgcagtcatagattttattcaggtacatgcgcatggcatcctcggagctgtacacaccgtctgttacggaagcatactcttccaagaaccacatcggctgcatattcttggcgcgttggtcagtggcggcaaggtagtcggtgaagatgtcataactcaagacactttctgggcaggcgtatttatacaggttttccttccatgttctttgccagttcccgcctttggagtaatcgcaggaatcacagaagcgcaaccatcggtagaggttatagggcactttcttacccaaagcgtaatcaatggcgagctggtcatcatcgacaagcgattcaaagtagtaagtccatgccgggaaggtatcagcagagatagttccgttatccacgagtttttgaacccatgaggacttgtccgttttcatggccatcatatcctgaacagaaccaacgccctgaaaccagtccataccttggtagttaagaagttcgaaaccttcaaccggattcaggacgtcaccggtgacattccatttgccgttttcatacttcatggaaccggactgctttttccatgagctgtcctgatacctcattatccggtacgaactgccacaatacagggaaagcaggtacacactgtccgtatcgaggccgtcagtctgtttgaagcgtgtctcaattgcgtctaaagtttcgtcaggagtaccgaagaactctatgaagtcaccataattcaggcaacctttgttatagccgggggtatctttgaagccgagggcgaactgttcccctttgtcttctttccagttgcctttggcatggaaatagacgttttgcaggctgtcatccttacaccgataggtggctaccgggtgattggcggtggagtggttcatctgcaagccttcgatatgcaagtcaccgctgtcaaatgttccgtcaaatgcacgttggacaggtgtcatatagttaccacccaaggcacggtatgtaacgttcatcatttcacaggcgccgcagtcgttcgcattgccggaatcggagtaatcgacttttacggtaatgacatcgaccgggattgtattatcaccgacctgtactttgttgatggcagccaaggctattgcacggcgtccttcctccgtcgtatcgtccggattaagtagtatgattcgagtgtccttgtttttgcctttgctcttggcgaggtagtagcgtttattctttaccgggcgtttggcagaggtggttccctggttgcgggtttggacactcacggccttgaagttacgccacggacgttcggggtcaaagtaatagagcgtgatgtatatcttcgtactggtggaagtggtgccgtccagtgcttctatatcggagccttcataggggcattcgacaatgtaaggcataccgcgtgaatagatttcggcagccgacgggcggctttgggtgctaccctcggccgtctggcttttaaggacgtcctcaaaggcgtattccttcaccattacctcggtatcagtcagacggacaaggtagttcttgaacgcctgtgcccattccatataggagttccaggccatcatgtaataaagatacaaatcacccagtttgccgtccatcgttatatacttggtctgaatcagggagccgccgcccggaacataaccaaggcaggcgacttcctcaccgttgaggaagagtttcatcatggaataccgtgtgccgtcacgttcaacgtagttgcttgcaggttcaacaaccacggctacggttatcttttcaccctgtcgataggcgcgttcttcacgacgggaaacgccattgttacagaagatgccgaccacccggccggtgacatagaagccggcaccggacgtttcgtcatagcagctaaggagcagggcatcatcatcggtcacgttcttggaagcgaaagcgaactggatggcggcaccgttggattcgatggacgagccggcaaacggggcatggtttaatgacacgcccacattctcggctacgcgaaggcagttctcacccaagaatgtgccaaaaccgttggtagtccagttggcaccgtccactttcatttcataattaccgctgacaatgctatggtcagtttcctgattggtacgggatgagaagtcaaagttatagatggcgccttcttttatggcggcgtcaatggcggaaccgctaactgtcacccggacaggttcgctagtcacgtccttgcatacggcagtatagttgaccgtatcggtgccgtcagccttgtagccctgcagttgttgtttgacctgataggttttgttacgactggcagcaatttgtgttacctgcacgttattggctttcacgctgacgggtgaagtcatttccaacgggtcataacaggcaacatcaagttctacggtttcgtacagtcggactactccaccgtttttatcatcgtatctcaaggcgacaagaggtgtggaactattcgggtcaattaccatgacagccgtgtagatgacatttcctttcactccagatgcgacatccgttccttggatgcgcaagggataggtaccgtgttctaggccgagggaagcagggcggattacaacggagtgcgagtagttgtcatttacaacggtggtagacagggattgccattcaccattaatcttgatgtcaacctgggcactgatacctttatcagaggtgttgtttccgaacttatagagtggaaggctgaaactttcagttgtcggagtaagcagagtttcaggggtatagttgagcacctgcacacaggtacaggtaatatcaacagctgttacattgacattcttggaaccggtgttgccgctctcgtcagtggctatcagcttgaatttccgagtaccggcagccgtaaagtatgtggtgaagtccagttcaaaggagaagtccttcatgtcaccggaagatgctttgttgacggtttcagtccagacggtaagcccgctttcacggtctacgagttccagtttctcaatcaggttgtcagaggattcgacaccgttcgaggtcacggaacgaatggcggcaaaggttcgtagcgtggagccgtaagagccatagacaggtgtcgactggaaagcaatggcaacaatggtaccaccagtttgaccgccgccacccgtgccgatagcgaactgcacttcatcgccaagggtttcaccggcagcgttcttcatctgaagttttacaatgccttctgtttccacgtttacgtcgaggttggccggaacataggcataggcgccaccagttgaaaaggcgtcctttcccccttccgccggttcatcggaagtttcaaaaacggaaccgccaccaccattcccgaagggtttccaaagagaaggggtcgcaaaatcggacacagcaccctggaactgccgggtttccatttcatactcgcctgttttgtaagtaatgatgagacccgttcgctcatatttgacgccagattcctgttgataggagacaatggcggcaatagcggtttcaagggtatagtagccgtctttcaatgggcggatctcatcaacaatgacgatggggtgtgttacatcgtcagcgggcgtgccgctcttcatatcctcaagggcttgcttatcctcggcggacaaaaggccggcttgttcaagggtagcggaaggcagacggaagctgtcatccgtttctttaccggttgttttggacactttcttaaaatacacatcgagataggaagcgtcagacaggacggagaaagaacccggtttgattatatcggaagggatatttttcattgtatcttccaaagactttccacggttgccggggaaagcttcttcttcaccttccccaagagacaacggttcaggcagacattcagaaggaactttactttcttcgttcaaaggagcgataccgttcgcttttcctatcctttcctcaaagccatttattacagatgtccatttgccccatgtaacactctcattggaaacaatacctattcgtgagattgtacaaactgtacctaaatatacaccttcggcattgtctgacatggtagctaattgtatacacgaagtgaatgattgacaaaccttattaagctccaaccgttcaatttgtatatttacaggaatcttagacgaatcaacagacaaaatacaccgataattcccaatagaagaatccccggaatacattgtttttaatttatctttaaagctaccaatagtagtaaaagagccaatacttttaaatgggtcagtcaaaggattggatttatcagacactcctgttatacgtttcaataactcggcgtctccatccgataaatcttttgcaatcttattgacattctccactaatgcatcaaaatccccattcaccattttagcaatggtacttgaaagtaaatcaatagatattttccgaccgccactaacttcaacgtacatatctttggatagctctgttgtatcagtcagttgctctattgtaagacagtttgtcttcaacgcttgtaacacaaggctaataatctgttgtttttctgtttctgtcataattctcttttttaatcattttcatatacccatacaagctcaatggtcataccaagattatctatgtcgcaatcatagacattatcaagataaagttggaactccttcagagcaccaatatctccaccgttaatacctttcaagacacatacaccatccctactaattgcactcccttcaatgaggttagtatacgaatctcctttatatagtacagcacgcaaatttatcgaaccgttgtccaaatcgttctttagtctatccagtccattaactgtaagtttaccgtaacctcttctaccaatatacttgttatctatgtcagtcgtcttgattgcaatcaaatcccaatatgaattttcatcaacacctgggtgatgaatactgttgacagtaaccatagtatcactattaatagaaactccagtattaggaatagccttagtcatattgatatatgctccgacctctgcaacctcactttctgaaccatacttgatactacgtattccttcatcatctgctatcctataagccccgctttgtacacacctcatagcaagctggttattccattccaaaactggattcatcgttcttaccttctgtaacatttgattgaacacaaaactcttcaatccctctatttgctggttaagttctggaacattactttcctttctggtatatcgaacaccatcaaagtagacgtaattacagcataagacacgattcaataattcagcaaaccacacagggcatcccatcccatttccaagcgtgaataatactgttgtatattcgtggctgaatagctcaacaatatcctcatcagaggtcacgaactgctcattatccacaccgaacgtccatccgttatctttgaaaccaccaggaacgcgaaaatcaaaaaagtattgcatcccatctatccaccagacagcatcaagacgctgcttattatctttcattgaatactgaataaggctggtttctgataactcacattcatcgtccgtaactttaaaaatctcactcgtattcccattaactgttacagtatagtatccacatggaagcaatgaaatgttatagaaataaagaatcttatcatcattcatcttccatgagcttaatgatacaggtgtagatatattacttaaaagattattaatgtaaactataggctcctgctctttggctgtcaaaatcaattcaacaaaaatcctgtctgtacgtgcgaataattgcacatatttactcttcgctccaaatttatcggtagacggagaaaaaaacagtggggtaaacgggcttataatcatatttctaggcttttgttattgaacggacaaataaatcatacttcactccctcgtttctctcaactgtactactcacctctttgatgtagccctcgtaaactagatcatcttttaagattttaatcgtttcatcatctgttggtggaatatcttcattataagttgtgaatgaaacatctccacaagttataataccactttcaacgttaaaatcatctttcattcctataccattgacaacaacatcactattaccgtcagaagaagaataagatagttttttagtgaacataccaatatagccggcatttgcttgcaatatgcctccttgccaatacatggtattaaacatcgtttcaggatcaagtacaccacttatttcccaaccgctccttataagcctatactctttatatgtttgtactccgccattatcatgtaatgtagtactggcacaaacaaaaaacacatcattgtcactttcactatccgttgtatcttggcctctcttttgcgataagaattcaattccataaacatcagcacggtaagggctaatcaactctaatacattatcagttatatcaatgccagtagtatattcagtagtaaatcggaattcgtcacgaccattcatactttcatagtcctgtttatcatatcctaccctaaccaaagaatatattcttgatgaatcaaccttatactcaaaactagaaaagctgctatttaaatcctttacattgttatcactaaacaatttgtcccggtgtttaaaaaaaacagtgacaccattgatcacaggcacaaagccaaaaactgtttccatccagtttttaaactttgtataagaagtatatagcttagcttgggggattccacggatactttcagcagctaatatcacgcaattatctaacctttcatcaacacctgaagctatttcaccatagataccttcatttccaccattcatgcttttaagcaatcggtttaacacatcaataggtcttattgcatccacatagatagggttagctcgagaagtaaagcgtgtctcaaatttgaaattacgaaaataaatattgccagtagaagcattaactctgttaaatgttaccttcaaatcaaaaaataaagcctgccctttagtcagatgaatcttgatggattcattcagattacttggagtaacatcccccttattatacccccatcttttcaactcgactaaacgaccatcttcgtaacgcccacctagaacaatttcagctttagttgtatacgcatcactataactgatatagtattcaaaactaaaattcaatactatatcaatgtcggacaaggctttaacaaatacatttggatcatctttcgattcttgtggtgcatcataaaactcaagaggtgaatcccgtgacggaagttcaccaccagaaatatataagggaagcgaatatgttatagcttctacatatattcctttgtcaattacaatatattgcaaagaagcatcattttctacagtattaccacctaatgtatgcggttgactataattcatacttacagaatcataataaagctgatatacatcttttatctcatctaccgaatattcgtactgcgttcctttgttagcctttatgatattagcgacactatcatctatcgaattaatagaaacagcatttccatcataggtcaatgaaccgaaatccagtcggcaactgaagaattcttcataagtatgagaattagttatagtataaacagtgatactagcattagaagccaggtatttgctcaaatactcctccaatatgagatcataggcttctcccacaaactggaattttgaagtaaaggttctagttattccttcaagtccggagcgtttacgggaaaactttatttcatcccaattctgaatacaagatttgggaatatcataggaaatactatcaactgtaagtacatatttacaaagcattttaactcgttttgaacgttcacgagcaaatatatagaaaaagccaaccggtttcccgattggctaaattcttgaaaattgcattttgcaaaagcaagacataactatttatttttcaacgcaatagataaaacataaaataattatgactttctgcattctcaatttacaaattaatactttcataaaaaagctccgaacccatatataaaggaacggagcctgcctttgtcttaaaacggtctcgcttcacagcggtacactatctttagaaagtggctgcggaaagttctttagatatacgttccaccgctacccgtatcttatcatattgtttttgtccggctactgtcacaccggaagtatattgtctcatcaatgaagcattgatacctgccaactctgcaaccttagtaacattcaggaatgagaaatagttgaagaaagactgcatatcatatttgtagataaactccaattccggcatttccttgccttcttctgcctgcatctcctttatttcctcatatgctttcatcatatcctctttcgcggcttccgccgtatctccataccctgccaaaccaaagccgggtaaatcttcctcgacaaagcatgagtaatacccatcgctcgccttttccatgattacagttactttcatatccattgctttaaaaataggagtacggcaatataccgtaccccattgtctcaacatttacagtcctttagataataaagcgcaaaaggtagggggattactcccccaaaagaacctttcttgctttacgttccattccggtaggcacttcctgtttgccatgccttgacagggcaaatttgtttcctgtcttggggctgtaccaaatatcatgattagccccatgcctaagaacgtaacaacctgctgcggtaagttccgcaaaaaactgattgtacttcataatgtaaaagaccgtttatttaagacgatacaaatatagcgtttttgctataaaccaccaaataaaaatataactattttgctatatttatgaaaaaagttatttccatacacttttaatcgatcatcaatatccaatttcatgaagcagaaacttccgaccggaagaaatacgacttcttacagttccaacaggaatgttcaggatttcacttatctcatcataagaatacccactagcataatacatcacactatcaatacaacgggattttttagcacaccgttgtattatggaaaccaaatcatcaaacagtattgaatgagctgtacagttagaaatggcacttccgtctaccatatcaagccctgtaaaatgtataagggaatttctattgtatcttattatataagtattcctcattataataaggcaccacggttgaagcggtttagaacaatcaaatttatcacgattcacaagtagcttataaactgtatcaccggctaagtcttcagcatcttgcatggaacagcagaattttcttgccacctttaatatccaaggatatatttctgataattccttttcaaagtccattgtcagccctccttattaggtgtatcttcggttcgccattaatgcacctttccacatatttccggtgcatgatactttgttcgtgcatttccttagcagaacgctcgattgaactaataagagtgcctatatcggggggcaataaggcaatcattttttttacctcggacacttctgctgttatccgattacacttcgtctctaatgtacgtaattctgacaataaaacattgtataaatgcctatttatacaatggatgctgttttttttattcataaaaaagtcgtttgtgattctaaaggagatgtacaaacgactgtatgaaataattcgctttaattaaaaattaatcgaattacagcatatatgtaataccaatattatcatgtgcttctttttctgatcgatatttcaacatcagcttgatgaacgatattcgcatagacagcagcattaattacacgggaatcaatactcattttaaagaatgtcattagaaaagcaatctctgcatcaaaagaagaacgaatttgttcaggagtagccttacttcctttatgttcctcactgcgtctctcctcattccgtttttgctcaaaaattgcagaatgaagtaaataatcaagcttcgatataacttgctcatcactcatatttcgggtatctacatttagttgacccaatacctgacgaacatcatcataaaagccaagagaaacaagagcctgacaaatacgaagactcaatagtttggcacgttctttcagcatatcctctttgtccattaccatagccttcatatttgaaggattaacaatacttctgtattcaatgagcaatttagatgctatctctttaagcgtgctctctgacacaaattcgcgacccgaaagcaaacaagcatagtttccgcatgaaagctcaatgaaatcattcaatgttatctgatttaatctttcaatcatgactatttcagtttagataacttatacagttcaaattcacggttagaagcatcctgacgctgcattttaagactcttcatcaaaagaaaatttgttctatcaacccttttttctaatcgggaataatcattgaaaacaatggtgtcaccggaagaagatgcaaaatatgtcggtgaaaatgtaggaaagtcccaatccggcatatcaaaattagagatatctaccttatcaacatcaggaaagacttgtgcacctttaggaatatcaactaaagttggagcatcaggagtaatccatgcttttccggaatacatgataacttcatgtttaccggcatcaccaactaaagcggtaccgccgggatgcctatcattacctttagtaccgtctgcataggaaggaataggagttgcaagaattgttgctacttgcatagcccccattgccccgataacagcagccataacagcaccggcaatcggacctaactggaaagcctccataataccacgagccgtcgcaattcccgtttctgctacttgtacccctttgttccaaacagcttgcttatgcgcaatctcttgcttttgcctttccagctctttattcttggcttcagtctgatcctttgctgcacgtttacgtgcttctgcttcctcttcagatatggcccccgattctgctaagttctctattcgttcaatatcctcatcatacttttcctcattggcttcccgttcttcctctattttctgaatctgtccatcataaatagaagagactaagtttccaatggtccccacagcttgagatgcagtttgaagccactttttcaagtttttctgacgctctttctgagctttctcatccgctttagtaaccttattgatagcctcaatctccgcttctgcttctttttgggcaaggtctgctttcaatttagcaagtttctcctctagtttctcccttttatccgtactcaaattggcagtagcaagttcggactccaaagcatcaatagctgcttcagcagttttacgtgcatagtttaattttagctgatattcaagttctgcatactcctgctgggttatttccttagaagctaactgttttttaagagcaagcgtatccataacatatgcagcatcccggatttcctgctcatgcgctgcattctctgcaattaactgcacctgatcggatgcatgtctttcgttaagttcttgtttcttttttgcatatttttcgtcaatgagaaaaacatcttcacctgttttctccgctgcatcaatttctgcttcacgttgcaactccaactggtgcaatttcaaatcaagttcttcttgggaccccttttttacaacagcaagagcgttctcaacatctttcttttcacggtcagaattatacttaatagagaattcatctaatttatcctgcatttctttcgccaaattctgacgaatagcaatttcttctttactataacccttaacagcagcaatcttctttgagtacgctaaaccaattttagcaagttccttttctaagccttcatccatgagggcgagttcagattcttgataagtttctttaatcttttgtttttccttagcagctttctccagttcacgtttttctttatctgtgagaggtttgttaaatgtacttcccatattttcctcttgataatcattggtaatacctttgatttgctccattttttctttcaacccagcaacatatgcagtttgctcttcaacaagcttgaaagactcatctatgtcttttttcatctgattagtagttttttgaagccctaggccttgtttcaataaactacgattattatactcactccactgcttttggtttcgtttagtataaagttgcaatctagcttcttcttgtgataaagttctttccaatattttaagttgttctcctctagctttctcaaaagcttctgcaccgtcaactccctcttttctatatttcaaagcgaccctatcaatactttcctccttagatttaacccattccttatccaatttagcagcttcttgaccgttacgagctgcattggctaatctttcttcaccaagctcttcagcagtagcaataacagcacgcatagaacgaacaagttcagtaaattcatttataattccagataaaacgccagtattctttcccaaagaaatcatgagagcttcccaagcagaacttaaactggcaattgctccctttgcattatcttccatagtataagccatgttccctaattcactctcaacacctgtaatctggtcacgcaaaggaactattttatcggcagcagttaaaaaagcgttgaaagcagcgacacttcgtttatctgtcatttcaagagtactattcaaatctactccctgctctttcaatttttgcaatccagcgaccaattcaggtaatgttctcaccggaccacctaacgacttggcaagtaccccgtttgtatcggctaaatttagaagaatattacgagtagcagtagcagacattgaagcatcaaatcctgcatctgccaacttaccaaccaatgctaaagtatcttcaatagagaaattaaacgctttagctactggccccacgattggaagtgcagtagcaagatatgaaaaagacaatgcactctttgttgtcgcaacagccattgcagatacatagcgttcagtctcacgggtatcagcattaaacattcttaatgcagctcctgtcaacgaagcagcctctcccaactctgcaccggtagcttgagcaaaacgtaaaacagattctgttgcatctaatatttcttttcttgtaaaacctaatttcgctaattcaatctgcaattcggtagcttcagaagctgtatatttagttgtagctcccaaccttttagcatcaagagttaattcttttatttggtctgatgtggtaccgagtattgcagcaagccggctattagcaaattcaaattcaacaacactacctacaccctcacgaagtttagtgaaaagagcaacaactccactaacaacagcttgtgcaccaatatatccagcagcccaccctttcaatcctgcaccaactttgtttagcccaggagccatctccgttttaagcatcattccagcattccgggcaataatacccatattctgcatggacttattaccgttctgtatttcaatccatgccgcctttacttcttcccgatatgcaccgatggtcattttctgttgactatatcgatcggaatttcgctttatgtaatcggtattgattccgattgtagaattaagacgggcaagcgtacgaatataattctcatcagtatctttcagtaaatcaacagccttttgaagctgcttattcatttcctttgcctgggaacgactgtgtacttcctgattagttagtattattgccgaccggataatctttaaacgttcttcttcagatagaacagctttcttacgagtagtattaccgacattctgcgcttttgtcaagttagcttccgctttagctgctttttccaaggacacagcattatcttgattagccttagtgagtttctttaattcagcagaagacagtttttctacatttaacttttcctctatcctcttgcttacggcttgggttatttcagactgttttctaagagcctctgttaattcgttagatgcagaacctgcaactttaacttgagttttataaatgttacctaacttctccaagtcagcgatgccgtccacatttatctttagaccttttgcaagctcaatagctgcatttttataagtttcccttactttaccaatagtattatcaagttcaatcaacttttgaatctcactatcttcaacgaaatcttttaattttaaatctgccataattacaggtaatgtctatattcaacaatctttccttttatctcaactcctagtttatcaaaagcataggtaccatcttctttctgataaacgacatacatgcaaccatccaagacagctgctttctttgcaagatcactgatacgttccagttcactctgcatcttttttatttcgcaactacaagccattttctaccgatatccacattctgaaaagaaacgttccatccagggacggagatacataatattaaagtactctttagctgtatcaccaatgcctaaaatctgctcaccgtatttcttctcaatagaactaccgtccgtaaatcctttcgttgagaatcgaagcccggaatcaattctatcggcagttatgctatcatagaaagtaccagtaataaagaggttaggtacctcaaccggacgcggtggcaaataaagcatctcacttctaagaggtggagttatcctctccttccatcgtttatattgttccgcacggttctgccaaggaccgggctcgttaaaataggtgtcagtatcataatcaggattcaatagatgttcagtaccgtccagaccggaatataattgctcctgaatgcaatcaacgagcacattcttatgttcttccatacacctaatacattcctcttcaaacccggatgcaatggaatgaataactctatgtaattcatcaaaatctgccatacagtaaaaatataacgggccgggctgtaatcacaccccagcccgtcggttacttagttatcgcatcgtacacttccgagagcttcttcttgcggtcagcttccttcagttcctgccacacgactttaatgtgcgcattaataaactcttccttcgtcatgcccttcacagcaacctcgacgaacgtaacattatctaccttcatgacacctgctcgatacctctgattcctttttcatacaatacagaaggagctttcaacgaaggaaccgccccggctttaggaacaatggtaatgataccatccgaatatgtagcagaagttacgttattcataacttcagcagcaccatcagcaataagactgccaaattcttctgtacggtcataaccaccaacaacttcaactattttgtaagtattttcggcctccaacttttgaaacacaacatcaaccaagcctttaacgaaattcttgggattgaagtctaactgcacgtagtcaaagtgcaattggctgtcttccacatcttcatgtgaaaaactaacagtcatcgcagacttagcactactggtcgggtactgtgtcacggtcgggtaaacagtagacatcggaataccggcaaggatatcagtgtcatcattataaccgatcaacatattatcctgattccaaaagtaaacgtcccatcctttattggcacatttcagaagctgggcattcaaaacctcatcaaatttcttcaaagtgaaggtgtctgtttgagcgctaagcccgttgtattcacttgcaccgtaccctacaggattaacttgaggctctccaccattcttggcatactccaggaatggcaaaatagggtaaatacgcccgggacggtctgcatggcacaattcgagcaacttctcacctgttatatcagcagggagtttgacaccatgttctgtcaagatagcacctttgacctttttccagtcaatgctacaagcagaactaccagtgttcatccgggaacccttacacgttctaatctttctcattttcttctacaattaagattattaatttttatttccatcgagcgtatatttatggcatcaatcggctcgctcacagcctcaccggaatctgtataggctccgtatctgccatatgaatagttttctgaataactatgtttcactttttcgtcatagtcgcagtcgaaccgagaatcttcatataatacttccaataaacgtttatagattggccgaaggatatttttaaaagatgtggttctgcgcatctcattgctccactctttacaagaagaacatgctataattaacgaaacctttgcttttgaaaaataatccgcatcacctctatcctcactaattggagtgaatagtgcaaccaatggaaacttcctttcagactgggcagaagacttactgtattcatctaaaatatctttgatatattgactgctaccgaagatgtaattcaaccttggggacttcataactttagttccccctttcccatttggatagagaatttcaagcccttctggaagttcctttacaatctcctcaaacagttctgttatatctaaatctatcataaattgaaagcattaattggggtcaaaagattcttggttattttcacatcgaaaggacaatcattcgacatagcccattcaacaaactgtttattcttctctaccatgctattccatgtgcttacttgtctcttcaaaggagctatatattcattagcacatttcaaacggacaagcccggttattgtagcctgggtgtttgcgtcacgaagaatatgataaaagacatagtcagcgaacggttcacacagcttctcgcataatactgcatatccggactggggggcttccttctcttctgaaatatcaacttcatctgaagaatcttccttttcccgttcaataagctccaaataatctgtgatagcttgggaaagagtcacaccaacaacattccggagaaattcgggctgaaatgccttaatatacccatttatcacctcattcacagcaagagattggggcgaaggcatttcagcgaccgaaacattctcaatatgcctgggacctgacataaaatatgaaacatcaatcaacatagcgatagttatttagaagtcttgcctttcccggttttcttttcatcttctacggaaacggctttatcatctgtaacagttacctccttggcatcttcctcttgcaaatcttttgaatcggcaaccggaagattcttttcatcagaaggcacctgtacttcaagttctgcaatgcgagctttcattgtttcacgctcttctgtcagttcaacaattgtcttatctttctctgcaatggatgcagtaagcctgccaatctcttcatttttttctgcaagcatacattccaatgtctttcgggcatcttcttctgtaacaagaccacattcggaaatagggatgagttgaatcatccctctattaatccgaatgcgttgctctttaagcacattggttacatccttatcgttacctctaagtatgtaatccataatcctacgctttagttattgcagtcttcaatgcggccaaatccccataagcgaaagcccacggcatataaatcgggaagataacttcttcttgtgccatcagcacaacctcattgcaaagcttggtctccacatcttcagcccattcaagtgtcaaagtggtataatcaaccaaatttgcggcttggttaaagtcacctaaaagatacttacctggaagaataccaccatactcgataatcggacgaccggcaatatatttcaccccatcaaccattttaacgataccaagattacgtcctgtcgtatctttttctgattccataccgttaacagtcattggattaagaataatagcattcggaaaatactgggcatatgtcattgcggcgaaagctgttttcactacatcttcagagttgggttcctcaatgttcttaaagccggcttcatgaacactgaatgtcattttatccgtagccgtttcagcaccggagaacgcgacaccaggaataaggatacgaccatcttccattttcacaagagcgtgtgttttgttcagttctgtaagaacagcggcaccagcgaacgtgatactcattccatcaagaatcaaatcctgtggttctgcaaactctacaatcacatccttatcaccgttatatccggtaatagcttttacagcaccggcggcacctgtaacaatggctgtactgataatcttctctacagaagtcaccccagtattattaataataccaagcaaattctcaccattaccgtcaccaaacaagatgttccagtcttctgccatccaaacagcttcaggaagcatgttcaagatgtaggaacgaatgtacactcttgatttcaacatacgttttgagatacggatatgagtaccaaggcgcttagttcctgtctgtatctcttttaccttgatgcttgattcaggcaaacgcccattctctgttacaaaacgggcattgcggttgaaagcatatacttgtgcataggcaagttgagggtatgcaggatcagcagtcaacgtcgttaatacatcacgcatatgcaactttttgttggcaacctgagtcacaacacgtttctgttgttgagtaatcaacaaatcaccggtgtaattgtcagtcatggaaacgacatctttcaaggagaagccgtcaaattctcctgatttgcgtgtttttccttctgcgaaatctctgaatttttcagaatcaagcatctcgttcaacttctcatcgaacttgttgatagtatccatagaaagacctttctgcttcattttctcgatactttcacctagagttttaacttgttctacaagttgctcgttgtcctttaccaattgctggaacttttctccatcataggctttcaatagattattgatgtcaccaaactgtttcgttacctcctccggtgaggcaaatccttcaagtgacttgttaactacttcacacatcatgccgacaatgttttccatgaaagttttctgttctgccggcagaccgtctgttttcagattaaaatctgatactgtaaattttttaggcataaaatttaaattttaagttatttattctcgaaacagctattcaaactcttgaaatcgagtaaagtgccattatcagcggctttaatcgttacttcatcgttcccattttccccgtcattcttttcttgagtgtcaacagacggctcattttttccggtggtattttcagaagtgttttgcagaatagcattcgaacgatatacttttccccaacagtggggacatcttacataattcataaggtcttgtagacccttttgagtaaattctttcttttctgatttgacagaatcaataagagaaattacttgggttctaatctccggagtgagcttctccatttcttcccttacaatgtcctgtgttatccatctctgataatcagcagcataatctaatacctgttgggcaaaggtatgctctgtttctgcatcataatcaaattgataaccacaatgaggacatgagacaacggcaccaccgttgaggctcttcagtaataaacttaattccatatcgtatccttttaaacgttcatcactatatccatgctgcaagaacgctttccggacgaaatcaacagcttcctttacctggtcagcagtagcagacttgatattcacaaggaacgtctgtggattactcccccaacttgtcaatgttgaatattccatcatacgccattcaagcaccttacaaggatcgatagaatcccttttgatggcttttactccgatagagtgttctagggttcttccattctctgcaaacagcttataatcagctaacgtatcacggccaatctgtttttcaagatttaactgaccgaccataaccaaattaccttctgtttccttaccactcaacggaacacctaacaactggtctgtacgatgattcaggaaccaacgcatccgaccaatattttctttcaatgtcttattgaatgagccgggcatagatatgtcattttgtgagtccttcacaccgataccgttcaccgcaacggtaacgatacccttctcatcaacatcatttgcctttgtcttgtactgaaggcttttgattttctcttccatctttttcatctccacttttagtgttaaaaactcgatttactttatccagttcctcatctgacatatcaaatttcaatttgtcaaacaagggattttctatcatactttcgcctatttgggcacgccagtcattgagtgttataagcccacatgagaattgttcacgacaacgtttatttatatttgtctttacgtcttcggattctttcaatccttcctgcaaacaatcaacatcagagaaatcacaatccaaataatatccccctccttcaagaccaaggaaagctgtaaaatccttgcagaattgtttggccataggaataacagttgaacaatatacgctcttttcagcagtagcctgattgctaaatgtggactggtcttttcgcggaacaagaacggcagggatgccgtatgcccctgcaatatttattgcatcagccaaagtctcttcaaacggctgtaactctgcaatagaaagattagtacgaacaaagtcaatgtctgcatctgaaataccataaggtacctggcccttccttacaccatacttctcaaaattttgcttcaaaagctgttccttttcatcgtcagtcaacgctattgaaccggtagcatcagttttcttacttacaataaagcccaatccaccccgctttacataaatcacatttctagcttcatatacagctattagatttgacattggcttattttgggaagcaagacgacttttggacttcaagaacatagcccctgaatagaactctgcacttccgtctctatcatgccatatttggtatggaggaatttccaaactaccattccaaccatactccaaacgatagctacgaataatatcttctgtttgggcaatgccaaacaatggtatattcccgtaaacaggttctacaatagtcttatcagaaggtagcacccaataattatcgcaatatctccatttttcagctgtagaaaagacatcaggcatagcggcacgaataaagctattccctgtacacaatttataaatatggtgctgataaatcaattctttccaacgcatcaaacaattaggacgactaagtatgccattcattcgtttattcgcccatactatactgtcatccttagttttcttcaattgaaaattagcacctgcaattcgcgatgcaatataatcgatcgggaaaaagacttcaggtatcgtactgaatagcgttagatagttactgcccgctacaataggactagtaaggtcctcaatgtatgcaactgaccatttttcagccttgccactttgagtatctatatccttattttcagatgaagtaactatttcaacttcacctttagtcttagatttctttccaaatagattatcaaaaaaaatattcattgggttcctttttgagcaaaactaagtaaaaaggaaaaccgttttccaaaacactaaaatcttgaaattacgaaaacataatatcaacaatacaacatccttattttcaatcacatataacgcaattcaattcaaacctaattttacaacgaactgtactagcccactcaaaacagcactggcctcttttgtttcactatctttattatagtccatcagattattcatgaaggcaacatattccgtatcagattctacttttgatgcagaaaaaagaatactatttttcacataatcagatgttgcagcaatacgcttatctacatccggaaactctttcattacacgaatctccttgtttgtactagaacggagttcccggataaaagggaaataagcatctgtacattcaattacacatgaatcagattcatgggacaaaatagaagaacgtatatcttctgttgaagtagtatccataaatacgacatcaacaacatgccatttatttccacatctaaacgcttgtataaggacaaatttcccattaacattcggcatcacatatagaatcttcttagtgtatttacattcggtatctggattgaagaaattaatagtgccattacaagcatacaagtttctttttcgccggttactaaactctatatactgctcactacacaaatccacaacgacatatcggaacgtatcagacaggtgtccgtgctcctcataagtctgcaaggtagttttattcttgaccttagttttaagaatggcaccgttagcatctttctgtacgctcatgtagtcctcaatagataccgaacatgattcgtcaatgtgtatctctataccgggaacagtacaatcaaagatagcattgataaactcaccggtcatggcaacactcggattcttgttgcctaccttatcttcaatctcgaatccttctttctgcaatgtatctatgaataagtccatccaggaacgcttctcatcgtcaatgctgtttgccgctttcgttgatgcatcaccatgtacatataacctatcagaatattggatagatttcagatactttgcaacaagtttggaagctttctttactgtattgttggggctttcagcacacgtttcatggaattgccaaaccttggtaccagttgtgaaatcgacctgccaatatgatacgctgatatacggaagcacgttgttatcgacagagatatgaataggtaagtccggaacatacttatgctcaccggaatgtttgccacgattgaaggaaccgaagaactcactaccggtacgaatgacaccccattctcccaatgcgtacacattgtaatagtccggatcgtgaactctatcatactcaaagtcggcaacacattgctcatcatagaaaccatacgtaccgtcaggactaccaacaacccaaaaattattcaaataggtagattggataataactgtattaggggcctgttcctcgatttgcttagtacgaagattaagtatttgcctgggtgcgttctttcttacggatttgaccttggtaagttcttccggcaactctttgccggcaatggtaacagtcatcggtacatcatgccatttatctttatcaataaactctttctttatccaatggctttcactgatcgggttaaaggtacaaataatctgctgccctttcttaccacgcaaacgcttacgtagctgcttgaaatccggatgctcgaactctgaccattcctctaactgaactcgcttatagttagagataccttttatcttctccggatcgtcaagaccggagaaatctatcttcgcaccatttaccagacatttaatagtattctgttgaaatttgaacaaatgggagatgccaagaccgatcgcagcgaccttataatcttcataaatggttttgagaatagaagctcctaccttacgcatgacaagagtgttctcaccatcctgtaatgtctgtatcagtattgtttgtgccacactatacgacttaccggaagatgaacctccatagagaatgataaaacggatagtctcatcattcaagtacttcaatagatagaatccgttaggatttagcttcttataatttataaccatattgttctaaaagtaaggtttctccgtaggatgaataccggattttgcagttcaaattgttctattcttccgaattctcattatcttcaaatccgatacgaagttcaccgactttatttccgtctccacctttgatgttgacattcttatcggcttcccatccattccaggcaccaagaatccgggcggcttctgtcttgccgttgaactcataattaaccactcctctattattctgaatcttcttcaacgcattacgggcgcgctttggaagttgggacggacttctcatctttgttttcccggtaacagggtctacataatgtaaatcatcgggatcagcgagtacaatatccattaataccttctcgaccgttttcctctctacttcagtctctttcgccctctgttgcttaatctcacttatccttgcactaaccttgctattggctaacaatctgctagcagcactccaaatcgtttcaggtttcatctttgacgcatcataagacatcctatatgcttcactagcattaccttctgtatcaacgtagtatttacagaatttctcttgcttgaatgttaatggtttctcttgctttcccatatcatttgttatttattcctacgagaaaaagaagctgctctctatcctttaaaagctcataggtggcaagcagtgtgctgccagttgttaatatgtcatcatacactattattttcttttcctttatcggacgaagaagaaagaattctggattcaatctatctttagttaggcactggattgcattctcatagaatggtattttcaccgcccccgcaattttcgtacagatagaggttgaaaaatgaaagccctcgttgtgtctccgtcgcggtgtggtgactatacaccatccttcatatccccctactatgaagcggtggagaaactcacacgctctctctgcaaagaatgatgcaagttcctccgactgtttaatttctgaaaagctggtaccagtcttggaacgggtgaactgggagatgtaatagatatcaccctttttatgaagtgataccttttctttcagatcacataaccgttcctgatgagaccagctcttacatttcaccgcttccggcttatcccagtcgtcaatacgacatatctttccctttcctttcatcaaagatcttctttactccgtcctcgacagatgtgtaagacaaaggtactaaatagatatcccggttcaccgactgctctaaattgtcaaaatcccgtttttcattaattagctcaatttcaagcggtttgtagtatcttactaaagaagcaaaatacatagtagtcacaggttggacgttacaaatattgataagttgccggttacaacccaccgaatagataagcccctcaatgacatcatctatgtaagtgaagcaccggatattctgaccacagttgtataatgacacgttttccttttccatcaggaaccagagaagagttctttttcgcggattaggtccatatacattatgcagccggcacccggtcgcagccttacaatagatagatgcatactgttcatcgaaatacttgcttattccatacatagaagtggtattctccggattagccgttgacgaactggcatatattaacttcacatgattttgattgcaagcatcagctactcgcatgaaagtatcaatgttatccttcctgatctgttccaggtttccattaaacacactagtttgcgccgccaaatggaacacacaatcaatacccccatttttcaggagctcacatacttttgtggcttcaataccagactttcgatcaagtcctatgacttcgacatcccttttagctaattctcggcaaagggctttaccaataaatccctcactgccggttacaatcatttttctcatcatcacaaaaactaaaggtgcatcttgtttaaagacacacctaggttcaacataaaatcctaaagattaaatcttatttttgaaaatactccctacacttaaaaccctttctaggagtaaagtctttaaattcacagcttctaaacacccacttcttatcagcccatccggctaaatccttttgccattgaggaataatttgacgtggattattcaaatccctataaggctggcaatgcggtaagaaccgaccgcctttgttcttccaatgattgacacgctcaaacgattctttgaagtcactgagcaggatacaataaaagaagtattcgcctttgtacccgtacttgtcaatcaaagctgtggcacgctcacattcggcaatctgtcccggtgtgtcacagccgaaccgtatgcgcttcatccactttactcttgccagtagccgggcgatgtcgtctgttaccaagcgagcatctaagccctgattgaagtctactcgtacgcccatggagacaatcttttcaatctgttgtaatccataatcggatgcaagtacattgttatccatgagtattacgttctttcgcccggcagatacttcttctatatccatgtatggagttatgttgccttctttggcaggaacgacacaccatttgcaacgattaggacagccacgggtaaggaagccataagccagattcttatcaatattatacaggttatagtcgggaactattttatcaacttctactggaagaaccttgcttatgtcataccctgtaccacctttctcaatctgattggtattgatgtaatagccataatctggagtaaaggagaatacctttgccgaataaactttatcgtatgagcacaaagggttataccattccacattgtcgcctcttgccttgtgccatgcacttatcttcatcaaagctagattaggataattactgtcaactgctaatattccgatgttcattactaaaacagttatactccaattatctcatcattgatacgaaatatgctatcactcacaaaatcgtatatcttatacataagttccggttcttcctttttcggagaataaaccatcacctttttacctgcacctttcatccaacccgcttctgtgttagcagaccgaccacaagggagaaccataacgcagacatcagcccactgcataccgttgaaatccgaatcaaaacctttctgcgcaattgggtgattaagcgcttctctatattgctctgttgtccagttctgccaatcaggatctatatcagaccattggaaaccaccattaccatgtgggggattcttaaaatcgtaaacctcatgtcctaaatcacggagaatatctacaacgtcctgttgaaatacatttctccaactacttgctacataaatttttgccatattattttaaattgttacttttggatgtcgtttgcacggtgcaagcgacttaattttatttttatgaaaaacataattttaaaaggactcctatagctttactaccgtggggctatatggatgtccaaaatcaattagacggtaggatgggaagcatttttcaatctcgtaagtgacagttattagttaattgaatacgtgacagagtgtgtacccatctaaaataaacaggaggcggctttgcaacccgccttttgcttttattcattacagactgtattttgagtgttatttagaatattgttgactctttgtgcaagttccggttccaaacgcaccaatcggacaatcatcacaataaaaggttacacttctataatctgcgccacttccacatggatgttcactaagctccataactttatcattaagaagctgtacttcttctttgagcttatttacctcactaataggggtcaaagctctatattcttgttctgttaatatgtattgcataatttattcctttctgttattttattcctccaatagttttagcagtgattttttatactcgtctatttccttaatagcatcttcttgacctgattttgcatcatttatcattaaatctgctactccctccattatttcatccttatgcctattcagatatttgataaagtattcctgcatcaaatcagtatccatatttgctatatccgaatatgtgtctccacttccataactgccagaaaaagaaaaataacaaagattacttatattcatactctgaatactctcccttctgccaaatccatctgtatgcttatctattccactattgctatggctttgaaactcttctctgattttagggagagtttctttaataaactttttcagttttctgccagtagtgattaacttacttaattcttttgctgtcatcatcagtctcctttctttttaatccgttctagtacatctctgttggcttccaatatttcatcgaaagacagaataggcatccaacatataaccttaatatcatccttttcgacacttttcctaaatatgatatatcactatcagtagtccatataccattttcatacgtgaatacatctatatgcttacgtgattcagcttctctatcatcgtatttatagtaatataaaaatccgactaaaacacgctactcttcatctggtaatcgttcttctactcttatccatggagattgctttttctgccactcaacaccagacgcaaaaactttacgcatatatgtttcaaccacatgcggctgattgatgcgatttgctaattgagctaccaatgatttaaaattcatatctatcttgttttgagcctaattaggctacatcgttaatactaatttctcctttcaaaactcgttctacctgcctgtcgattatctcttgaaactctatctgacagataagcgagcaatccggtataatctcttctactgggtcacctcgccatgttgggagttcgtcaaggaagattcgtccgtctttatcttttagacaagttgcacctacatcacgttcaatctgcgccacctcgttaaatacatccgggaagtcctttcgtatcttattccagtagcccattccgcctttcacgcaaccgatacaattgttgttattatagcccatcttgtacatagcggggatttcaataccggctttccaaagcattcccattgcatcctgcttcgtaatctgcttttcaataagcgggaatagtggctttgtgtccgggtactgctgttttaatcggatagcccggttaatctctttcgggtcataatcgaaaccccaaacttgaccgtcccagtgctgcaattctttttccaacttgtagcggactttctttttcagttcaagagtacaggcggcaccatgcgcgccgttgatatacccctttcgcaacacatcagacacacaggtgtacttgtcgcttcggataatgtggatagattgattgtaccacttttcacaatctgccaagaatctagtgttatcgggatgaccggaaccagtttcaatatagtagatatgcacatcatcgtataggcttaatgctatcttacaagcaactgcggatgtagcaccgcaactgaaccatgctattatcatttgattcctttctaattttattttaattatttttttgcaatatcattccaaaaagcaacgccttcaggagtattattaaaagggaatgaaatagttagaaaccaatgaaaacagcaatcaacatctaacaaattgttcatccgctcttcatttgtcattgagaagtcaggacactcaatattaaatgtctcatttgctctttctgtattatatttccattgattgaaaatacctagtctttctaattttgctattttttcattcctcttcatattgattgacttttagttctttacatctataaaggtaatcattattgacaagttttacaaacagaacattcgccaatttaacgccattttatgctgcaactgaccctagttcacgtaactttttactaatacattcacagagaacacgtgccatgttaacttcgactgcattccctatgaatttcttttggtcagcctgtgtaccaattaacacatagttttctggaaatcccatgatacgctttagttcaggtatgcgtagcattcgcattttaatatcaattatcccgtataagcccatgaactcttttattttttttgtcatagggctgtcggtatcataaatctcgattactacatgtccagtttcagttgcgatcaaataaggcggcattttatccatacgtgctatgagagtgaagcatggattatcaacggaaccacctgcactattaaattgagggttcattaggtagtgccactttctatttgcagtgactgtttgtgcgggctcttctatgctactaccaacgttggagaagtttgtattcataatccacggcttgcagctaacaagattgtacttaggattggcggtaatacatccaagcggcttttctgtagatgaaggtttgctgtttccatattgctggtctatgaaatatggagaaacgagagataaccgatccttcgttgttacggttgcagacggttcatttattgagcggttaaatccgttaccgtaatgggctgatacaaacgcatgatggtctttgcatgtaattgttccggctggttcattaatagaaacattcttgctttcggggtgtccactgaactgttttgaaagaaagcatacctgcgcaactcccagtctgttttgcgtagctactaccgggcatggttcgtcaatcccaggggcattatattttccagtccggctcatggaattatatttgataagaaaagcatctttgcccccggctacaaattttatcaggccggcatagatacgttccattgtcttttcagcaagtggcttctcacgaaaaatacttgttccttcatcggaaaaatccagtatctctttaaccgggcgccacttttccaaacgaccaaacatatcttgtttaccgtttttacagtgagtgggttgtggaaatactatcggtaatccatttttggcaaatataccaaagaagcgttttcgagtagtatatgcaccatagtcggcagcattgagaatacggaaatcaaagttgtagccatactttcttacgttgcgtacccatctttgatatagtctacctttatccatgctgataggctttccgttttcgtccatatcaccccaactcataaattcttcaacgttttcaatctgaatgtaatccgggcaaatagcttcaatgtaccggaaaagatgttcagcaagtgtgcgactatcagcgtcccgaggttgcccaccttttgctttggagaagttcgtacattccaggctcgcccaaagaacgaccgctgcacccggatattgagccttacatttggcaagatgttcaattagcggggaaagttccagcgtgcgaatatcttccgtaaaatgcaatgcatccggatgattggccgcatggcttgcaatggcgttggcatcgtgattgacgcaggctattactttagcacactgtttaccatcaattcttgcagattccactcctgtcgaggttccacctgctccacaaaacaggtcaatatataataaatttatactactcatttcttttcttcaaatttctttgattattgatttcagacatacacatgcggcaccaagaagtcaataaatgatattccttaccctttctcactactatacgattgtagaaccggttcaagtagaagtaatttccgcagtgtgtacattttttcatctcacgtcctgaagcatctataatacgattgcgaggtttgcgatgaataagagtacagtttttacactcaccatcagttccacgatgccgccggcaatgtgataaggattttgccccacatttagcaaacaccctacaatctctacgaggtattgattgatacacattcatggcttcctcgcattcaagaatttatttactacacgagaaagtacatcctcattctctggcatcagccattctttcgcaacgttccaagcaatactcatagttggattgaagttatccttcctgacagtgtggtgagacaaacgcccttcagtgggtttcaaatccttatcatgtaagatacacagtccattttcgaagaaagcacaaaactctttgccggaaacaggttgaatcatcggaatagcaatattaataacccctaagaatataccagcagcccagtttgtcagtgctaacctgtcggcataaccagcatctataattcgttcaatatcatcaggagtacctaaacatggcgtatgacattgttgtttacaaacactgcatgagcattgtacaggtacacgacctgaagccctcattaccctttgtaatgaggtttcttttgataattctctcatagtaaattatttgagatactacagattattaaacatcgccccacagctttactgcaaggtcataattttttttagcctcttttactgctttattggcataagccatagcgtatgtatgctcgcgtcggtacttaccggacttcaatccttcgtgatattcttttgcttgttccaacttatgttcatagaaatctatactttccggcatggacaagtttatcgtattagcccttttttcccaatacttcgcaactctttcatgttcggcagccttatcgctaaactcaacgcttttccccatgttattccaggcatcatctatcattttgcgatgtcctcgttcgctatggtgtccaactttgataggctcacccaaagaaaggaaatcgcgatgtttatttgatttctgaaaatactcattacttttttgtactgccgatgacgcccattcatgcctgcgttccgctctttgcttagcccattcttgaacattaaagccgtcagctctaacgatggagtaatagtaaaacccatctttctcgaagattaggttaaatactatactttcgttctccttaccatacttggtggtaacctcaatagtttcacctttttcgtgcttctcatcacactttgccaaaaatacatttggcgcaaatttgtaatacgtgttcattgttttaattaaattggtttgacttatatgaaaaatgagaaaccacagctacttagccgtggtttcatcattaaataactttggttgactgggttgaaccaaatcatcgaataaaccaggaacacgaggttgtaacgccttgtattcttcctgaaagaattcttctttggttctcccatgttttttaccctttcgtgtatgtacatcgaaagtgtaatctggaataggaataggataacgcctgacatcatttatccacttttctatatcaatatcctttctatcatagatgaagttttgcaaatgatccgcatcacgattctttctacattcacaaaggagaataacagctttactgacaaatatcctccctttgggttcagtagcagtcttgtttaccagctcatgcccctgccacaatgcttctatctctttagtaatgattccatagcaatcttcagcactaatggtaaacagacgcttccacacatagtcgcggtacccactcgcccaaagttccaatgcaaaaaagccggctaccccggtgtcggctcgcctaatggctttctgcattgcagaactcacctcaaagaaatcatatccgcaaactgttcttataatcataattctaatttaatggtttgacttttagtttattacatcagtaaaattagctaaaaaaggcgaatatgacaaacagaatggacgccatttaaacgccttttttacagactattagaatttgaatttgcatgatatattatattgaacgagctgctttgttttgtctttcccattagtggttgcactctttagcaaaatactatcaccaaaattctttttgataaagaggatagatttacgttcctcttcctgattccttatagaagcaagcccaccagcgtttacaaaagtgttcttttgctcaaaattataccgcaaatcggttaaaaccttacgttctttgtacttcatgtaacaagaaatccaaaaatcttccttcaaacgtatttcctcattccaccaagtgtttttgttatagattactccataactgcaaccggttatcattttcgaaagagaaagaaaagcggattcatcatacattaccggcgatatccgagcggtgaagccaaacagatgtacatccatcatactggccatctcaaataatgactgaatgatattggttatcttatctttatcctttatccggctaggttctcctttttccacataaataggtttgcaggcatggacatcatcatcaagcatgaaaagttctccaaaatgctttgccatccagttacgtttcgggatgaggcccataacatcgtcaggatgagtaacaatttcacattccgggttaaattgttgatataagtcagcttgactttcagcaacgcaaatgataggatcgttcaccaactttttagcgaacacccggtcatggcgcttatgacttggtattactattttgcaaggcatggcgaacgtcttttatgtcgattacattactcttacttactttcccggtcttgtacgacttcatgtgctgcatatccagcctttcacgaagccagttgctatctacctcattacttgaggtgatgataaacaactcatgtttttcgtcatactttggaatgagaggataaatggctgtatcatccgtgatggcatcgaagcgctctttaaattcatcctctttcttctccggggcaaattcgatgccccaatcttggagttccgccttattccactcgttttccataacgtccaaatcattctcaccaaaattgacattatctttagtggcatattccctcaacttcttaacgggggtatcaggtgccagaattttacaaggcagttctttataacctaactccttgcaagctcgcaaacgtaaattaccacaaacaacaatatatctgccatcattgtagggaaaaactataagttctcgaagttcaagcatctctggcgaatcctgaatgcttttcttcatcgcttcaaagcggtaatcacgaaaaaaacgtggatttttcggcaatcccgtgagctgccccttattaaaatcaagtaggcagacttgaataatctctgtcataactaactatattaaaatcaacaacacaaaatcaacaacacaaacagtcagtaacaacacctaatcattttttctatcatcgaactctatcttatctttgataagctgttcaatgtcctcacaaccaaatctttttaaataggcaacaaggtaaattatcatctcggctgccaattcttcatcttccgaatatttaggaagattatcactcctatatttagaagcaatatcgaattttctccaaacggcttcaattcttatgctaaacgcttttcttgagctatgctcattcatcttaaagcgcttcctcatgatattcaagcatctctgggcaaacctattcaatgttatcatatcgatcgggttaaattgttagactaagaataatctcacactatttaataaaggcggtggtctgtttttatacaaatacatatccattcttatttagattaaatagcttccatcaaatcaaatagcgtcggtgcattcacttcaatttcagcttcatgcaagtatgaaaggctgtctttccaatagtcataattcaactcggtagagagccctttacgccccaatctaatagcacagtaaggaacagtaccgataccgccaaatgggtcgaataccaagtctcctttatttgaataccgttcaatcaacctctcaacaatatcaagctgaagaggacaaatatgattttgacgttttttctgtgactgcttggtattgagtgtacgcatccgggtaacgtcatcccaaatccaaggtttcttacttacaggatctacggccataaatgtttttggtagtttaccgtaaacttctaattcttcagcgaaagcaacatgttcttcataattgtatatatgttcacgctcatagtttctaaacaaatggcgtatcttgtcaataccggcaactttcatatcttcatagcttaacaaagtattacctgaagatttccaacttgcatgagcatctatttgccagcgggctaacgaatattcattcttattcttggttactggcaaatctgcataggcacgtgaagtatcagaaggcagtttacggaaaagaagcacatattcagggcaaccaatacccatcttagaaccatctttgcacatctctgtatagccaaggcggtaggtctggttattctcccttaccacatcggtatctactgtgatacgccccatgtagcggaatccgtgtttcatgtagtgaaataccgtcatttcggagaacgggtcgatggtgggcataccgtcacctgtggcattaccgaacaatacacggtctttcacatggatgcaagccagccgcccaggcttcaatatccgcatcagttctggtgtgaggtagtccatctgctcgaagaacttgtcgttgctttcattatgcccgaaatcgttataggtcggcgtatattcgtaatgattggaaaaagggatgctggttacaaccaaatccaccgagttgctttccattttctgacactccaaaacattgtcgttattgatggctttccacagtttaccggatttttcttcacggctggcaaacatccagcgcatcatcttctcctctgcctgcaaaccgaacagaccgttctcacggacgatatcagtcattttagaaaccatttcacgatgctgcgcccatttctgcataaagcttttgaatatctctccttcactttctgcatagaccaagtaaaggtctacaggatgtttttgcatgaaacggtagatacgggctatcgcctgaaacttgtcattgaaccggtagtcgatgaacatgatagccttatgacaatggtactggaagttcaaaccctcaccaagcatttcaggctttgcggccaggtatttcaatctcccgtttttgaagtccgctatcaccttgtcggcttcctcatcatcctgcgagccataaacagctttgcaaccggggatagccttgcaaagggcttcccgctcactctcaaggtcatgccacaaaaggaaatgctcgtccttgttttcaggacgattaataatctctacgacacgggcaatcttctctgccatattgtcccgacgttctttcgctgcatcagcaagtccgagagcagcctcacgaaacatcttcacttgtccgtcacggtctgtaccggcagtggaattgtcaacgctaaccacttcttcatgtacccgcagttccggcaattcatagccggtatcaggataaccgaggtcggaaggcttggttaggaacaatgcccaagttgatacccacagccaaaattctttttctttgtgtggataaagcgttagattattagctttggtactatcacgttgaaaaaaacgtgtaagggcttgacctgtatccatcactccaagatatccggcataatgtatcagctccttgtatctgttaggtgacggcgtggcagtggcaacaaagcggaaaggcacatcggcgaacagcggtaggaactcttggtatgtcttggtgccgaaccctctcaatacgcttgcttcatccaatgaggtaacggtaaaaaaggaaggttctattcttacgccgtcttctccgtcacggacacgctcatagttggtaatcattatatcacacttgcaggctctgacttcgctcatggtcttgacatacttaactgtcatgttcatgtgctccttagcttgggtgataaactctactactacacgtttaggacaaacgataagagctttaccaaaatactggttgattataactctgcatatctccaattgggttactgttttctgcataccgaaactggagaatatggcacggcaaccaccggaaaccgcccaacgaacggtatctctcacatgagggtaaagagaagttgatatttcattaggattaacttcaaatccagtattgtggctaatagccatcttgtcttttagaaattctatatagtctttcattttcatttcaaataaagagaggaaaccgttaggcttcctctgtgttatcgttattaagttcttcgagttgctgtttgagcttcatctctttcttgctatatgaatctgcaagtttctttgttagcgcattgtaatcatccggatattgttctgcaaaaaggattttctgacacttttgcaaataggagcagaaattcacattattcgatgataagcattcagcaataaaggctctataccattggtgtcggtcagcttggttgttcttgacataatttacaaaatcactctcaccattccattttttcaaattcagtttttcaagataagtactgctacaaccgctaagaaccagcacatcaaaaacaagttgttcattttcagagaattcttttgttctctgataatatgttttctcttgcgcccacttgcgcatttcttcagcagacttctccttgactatatccttcgctctttttaattgggcgtttattttttccctttctatctcttttagatcggcaacagcggcagtactagaaaccagttctttctttgtgtaatagaattttacattaaattctggattataattaccaaagaatgagatacagcgataaatttcaccttcatcaagcatttttagtgtccgttcatcatcagcactataataacataaactcctaaacacctcatctggattaactacttcaaatccaagttgctttacggcttctaaagcactttcatattgtgcttttctttcatcactccaataatattctgcttttgctacaataacagtttttccgaatgaaaaaggttcacctactttaacaagattctcactctcaagcagaatctttcggattacatatgcaatccgctttctataaaaacaggcagcattgatacagcgagcattcttattattcatctcatagaacaaacaaccatgattacaggtattagattcacattgagagcactgcttaaattcgccattttcccaattgtctgcgtcttctttaatccaatccgctttatccagttctaaaaaggaattactaacatagtcacgtatcatagatgtcgtgcattgttcatcttcttcctcattgaactccttttgagtttcttcgtcaagttttgaaagaatcatagcaccggataatggtatgtctccatttcttacacgttctttcagttccgggataagaccgtttagctttatacggtcaaagacaaaacgagtagactttccaaatttaagagcaatatcttccaaagtccgtcctttctcagccaactgcgcaaaggcaaaagcttcttcgatgggatcaacatcttttctttgaagattctcggtaatcatcgcttcaaaagcctcatcgtctgtcatttctctgacaatgcaggatattgtctgaaatttctccgacttttttcgatgggctttgatttttgcaacattcgcttcatcttcctttgctttcaaaagtgacacagcccgaaaacgacgctcaccgcaaacaatttcatacgaacagggaattgtcgtaacaccgccagtctctaagtcagtaaaatcttcggatttggctaccctgacggtgataggctgcaataagccttgcttttcaatgttgcttgcgagctcttcaagagctgcttcatcaaaagtctttctcggattcaaaggagaaggactaataaggtcaattctaatgttttgtacttccataatttaattatattggtttgacttttaattcattacatcagtaaagttatcgtaaaatgacaagttatgcaaacagaaacttcgccattttaacgccattttcatgtgggcttattacgtatttgaataaatcctcttctttcagtttcccgaagaagttccatatcttcttctcgtatttcagcaggcgtttcaccgttcacacttcgatacgttccaataccgaaacgctctctgatacgagcaattttatccgaatctttagtaacccagtaaattgtaactttcatagtagctatattctacgactctcgccacacagggggagaacattaaacgttttaaaacgatccactaatcttggcccaaaacgtttcttaaattcggctatgccaagattcgatgttatatgatacttcttgccatattgctgaaaaatctcataccgggcataaagaaattcatcaataactgaatcgagactggtaccatacgatttttgattttccgtttccagaccgatatcattcaagcagatattaaagggatttggtttaaatcctttggattgattctcattgtaagtgtacaagtcaatatgcccgtgaattttataataattcatcatttgagtaacagacaagttttcaaaagcattggggttacaagtgagtttcaaataatctgcaaaaatctgcatcaacattgtttttccggtaccaggttcaccaacaagcaaaagattcttatgaaccttgtaattctcttccggaaacacattttgagcataccgacatccgttgaagtagtacagaagaaactgaattagtttagagttgttatcatcaacatcaaattttctaaactcccgttccgtataatccgtaccaaggttagaaattaaattccaatgactgtaatactcttgcgtatcagttaagtcatattcagaaacgttctgaatactttctttgtgcctttgtatcagattctctatctgttggagcgtcagcttgcgcttgccggcttccttctccatcaaattttgaagtttgcttgataaattcttttcctcttccgtcatggtctaattcattttttcgattttcacgaatacgatccagtatccaaaggtttgctttggaatcccaccgctctattttcactccattggcattcttccaccctatcgagtcaaagtgattgaagaatatttctgcttgctcttgccagtcatctaaccgttccggagcattttgcttgatgaagtgttgaataacctcatcaagcgtaggagctataaattcttttgcgactcttttaggtttctccggtttagagagtgggaaaagctcgccagagctactttctttcttaccccctttagggggttctttctttgtctctgtcttatattcttctttagggggtatgggggagctttcttgaaaaggtgtccctaaagggtaccctaaaggtgtccctaaaggatgccgtaaaggtggtatattttgcatacctttttgtacaccttttatagaatacgttgatttattgcctcttccattgccttgtttacattcaataagacctgcttgaactaatctatttcgggcggacttgaatacttttacagacactcccacgtcagatgacacctttgtatcactacgtgtccagttatcctcccagcctaaacgattcgcaatttttagcaagtaaaaataaagcctcgtttcacagcaggaaaattgccagctttcgtcaagttcccaaaacctattgataagttcaatataagtcatatcaatttataataattccgtaagacattgtttatataaggttgagggtcagctttcagataatagcaaacgctattaatgaactcaatcaacccatgacaaacgacatatacactgccatatttctcaactaatgcctgccattctttttgctcatcagactgcgttccggcacgtttaccttttacatgtggagttttcatctctatgcaaagactgctcttaccaccgcgaggaaaaagcagaatcaagtcagcaacaccagcgatggcaccttcatatttacgcatagcaccgcttttctttgtcctgacgccgccgtttggtatagcaaagagtagagggccgacattgggaaacgtttctctgaaccaagttacacaaatgtgttgtatcttggtttcagaatatttcacctccaatttacgaatatcttcttcagtcatttttctgcttgttttttgaaatcgtagcacattcatttagaaggtcaacgatttgtttacacctgttcctgcaaccgacaaaggatattatggtttcccattcaggaccgaacaacatttctttcttgtattcctgaatatgagttctctgcccaattataactaatctaaatggcttcataatttatccctaaacaagtccattgcaagattcaccatattcccttctacttggtcatccgttccggttacaccgttagcaatgttcttctttgtttgaatcacatcatacatatacttgtcaatagtatccttacctaagaagtaatagcagttaacgttgttcttttgaccgttacggtgtgctctatcttctgcctgttcgcaatcactgaaagtccaagggaactctataaaagcaacacgactggcagcagtcaaagtaagcccggtaccgcccgatttgaaattcagaataatcagtttacaatccggattattttggaaagagtcaacggcatattgcttttggttgacactatcggaacccgttacagtaacagctttaggaaattcctttttcagttctgctacaacttctttcaagtaaccgaaaagtatcagcttctcaccaccgtcgataacatcatggacaaattcacaaacagccttgattttacctctggcagatatctgctttaaaagctgcatctgcaccataacggcaccattcattgatttctgcacttgttcatccgaagcgttcttgtacttcttcaagtattttaccatatcagcctcggcagccttatactctttggtggtagtgatatcaactgtcaagtattgacgagtcttgtccggaagttgtgtaagcacctttgacttctcacgacgaaagaagcaagtattccatagtcgccaattcagctctttaacgttggatgcctgtttgggaccatcacaatatctttcaacataccggctataacctccaaagtcctctaatcgacctaatatttttagctgttgtagcaagtctgtattattgttaacaacaggagtaccggtcaatgcgaatatataacgtttacctttgcagataccttcaacatatttgctctgttgagttttacttgatttgcatttatgagattcgtcaatgataacagacctaaacagagagacacgctgatcgaaagcaatacttttcattgtaagcttggattccttatttacagcttttacaaaaaatttattaagcgattcataattagtaatgaacacctcacaaagtgggttgccatcagactttttacactcataaaatgattgccaggactgtcggtttctgtcatcaaggataatcgaattcatacctgcgaacttcttaaactcacgctgccagtttactttcaacgcagcagggcaaattacaagtactggaaaagactcaccataaatgggcgcttccttatgtgctttaacaactgcacatatggcttgcaatgttttacctaatccgggctggtcaccgaaaaaacagcgtttgtgctctattgcatactgtactccttcaagttgatactcgtaaggttgaagtaacatatagtgttcaccgacaaaaggtttcatcggaggaatatcataattaatatcttcagttacctcacgttccttgacagtagaacaataacgcatctgaacagcccattgcgcaaaagctctcacataccaattcgcatcacgtccaataggataacgcgtatcattgatactaacaagccacgcccggtctgttccgtcatagcgtggcttacttggtatcatctttatgacctcgaccaactttgggtgatactcgaactgaatccggtacagattgggcgtcttagtcacataaattggtttcatgaagcaggttctaatactaattcatgatgttcaactgttgaacatatcccgttatcttcaccatcttcattcattgcatcagcagcttcatcaaccttgtcaaacggatcctcaccatctttaaattcaaattccctttgaatctccgaacatttattctctgtaacataaagctctgcttcatacaagaaattataaaccgcatcacgaaactcctcacaatgcacatacgattcattgtccggatcgaaaccgataccaggagaacaaagattaaggactttgctcgtcataagggttcgcttacctgtcaacacacaaacctcaaaagaagaatcaccaccaatgctaacgccggttacattgaactttttgaagaactcatcttcaagacatgactctggacgttcccaattaatgtactgggattctttctgttctgtaatatcgacaatgtagggtatgagcttgtttagcgaatccttcaaatccggatgaacaggattaatccccttgaaaacaatatcgtttccttccttgtctgcatagaccacttcaagacatccctttttggtcaattttgcttttgaaatattcaaatccattttaattaaactttgagttaatacttacctatgcaggtattcattaataaaatctttatagtactggtcaacaggcaatggcaaattgattcctaattcggtggcagcatcagcctgaaccttatccatgaaagttttcatttggatcgtattcaatttagaagtacttccaacaaccgaaacaatatttccattcatacatatttgccgtggaagaaacttccggcaatagtaatcatgtacatccaacttatccgtgcctgtctccctctcaatacaggcaaaccacagccacatgagcgcgttctgcgacagggtacgtggttctacctttctcttgatgcttacagtgtaagttccattcttgagcgtggaacagaggtagtcaaacgacttatccattgtgactaccccattttgttttgttagaatagcttctgccatatttagaatggtaaatcatcaggcggtgatacctgttgatatggctgttgctgatatgcaggctgctgtacttgttgttgctgtctctgtgtaggctgttgcgttggtaacggtggtggtacaggagcagcctgttgttgaactttcggtgtaagcatctcgatactatcaacaaagacttcagttatgtaacgtttaactcctttgctatcgtcatagttacgagtgcgtaacttaccttctatatacaacttatctcctttatggacgtacttctcaactatttcagcagtcttattccaaaaaataagattatgccattctgtacgttccggcacctgggttccattttgtaaggtgtacgccttatctgttgtagcaaaagataaagaagctactttcgctccaccgtccaatgttctcacatccgggtctttaccggcacgccctataagaattactttattaacactcattttccttcctcccttatagttacacgaatactatccgctttagttgatgtttttaaatattgagaatatagttccgggtgatcttcctgaaacttctttgcatcaaaactcttacccgttgaagagggagtatagctaacacgcaaccgaccggcgtcccatgatttaacaccgttctcacgcatggcacttttaagctgttccttataacctttctgcacttcagcgatataactcgcctgttcctctatatcaataatagtatttactaattgcataggaataagctgcttctcatcggctggaacaggagcattaggtaagaactgttcacctttaatctcacactccagtaatctcttaacctctgcatccggcttacgctcaatctcgactaattccgacttatttccacgtaaccaaatgccaaacagtttatcaactttaattagtggattttgaagttcaaacaaataggcatagattgatagctgccaactcaaatactcacggtcaaggcttgcagtagtcttgatgtcgccaagactgattttttcgtccttttcccaaacacaatcaatattcgatgcaaaatattcattgtctgaaacagtgtactcattggcaaaagccttatatccggcatttactctttccctgatataattaatagcttcaatactctcgggtggtaatcctgtaacatcagcaaactggcattgtccatgaatacgactgcctttttcagcagcttttttcaatatgtattctggaatatccctatacttattgggaaatagttgccggcttatcattccggtaatacctttcagttgcttttcaccaagaaaatatgtgtggttctcttctgagaaaaccacactcgatttaaccaactctatcatgatgcaggataaattttgcccatttccatacaagcatttacaaactctttatcattttgcatagccggattagcataccatactttttcaagttcagctctgcttttgacagcaagcatgtcagcaatagcctttttcagttgggcaccagtataaactggattcttcatactagccggtgtttttgcaggctgttgtgcgtcttctttatcgtgagtgttagttgcatcactgtcttttgtatcatcaatgcaaaatagaccgttaagagcatactttcttgcataagaagatgaggctccggtaatttggctgccatccattcccttctttgtttcctcttctctcgcaaaagcagtcactatttctttttcccctttttcgttggttaaagtggcagttgcttttacataaattctattgcctactggcaccatctcatcactgagagttaacgaacactttgtttcagtcagaataggtttcactgactcaagaatatcctcacaactacggtatttgtaactaccgaacttattaaattgccctttcggggctttcagcttttgctgaatggttactaattctttcataattctgaattaatggtttgacttttagtttattacatcagtaaaggtaatcgttattgacaagtttagcaaacagaaacttcgccattttaacgccattttcaggtagttaaaaactgcctgtacggtattgtacaggcagaaaaataagaaaatgaataatccaatgtaccttatggaacggctacgcttgaagggtgtacggctccctgatttatacataatgtaaatgctagtggacggaaccggagtcgaaccggtctcacggaatattggtgcacatcaccgcagtttcaaccaacgatatacatatccgcccgattaattaaaaaggtgcactatcttcacagaccatacaccccaatcacaaacacaaaacaaaactcatgaactactataatttaattaggatcagaagggtgaatggcgtggggatcgaacccacatcacgcatatctgcgtatgctgccaattacaccagccatccgttttaagtgaactattctcacgaaccattcacctagaacacaaacacaaaataaaacacgacattaactattaaatagcactctcacgagcttcttgcttccggatagccgttcaaagcacaccggaatagtatagaacaattaaaactcaaataacaggggctttaaccctacagcgtccttttcgctggcaacattagttaaacataaaaagaaaaattctctgtgaaggaacccggactcgaaccgggatgacagattacctatgtatgactttcttcaatctatctgcatacttgcgtctaccaattccgccattccttcaggtcgtagccagacgcttccggctacattgattgaattgttattgatacaaacataattttccccctcacgggttacttaactctgattgagttgagccgggaaacggattcgaaccgctgacctcatgtagaaacatgcgctctaaccaactgggctatcccggcagatgcccggagaaccgggctaattggcaaatactaaaattaagcaatgttgaccttcacaggctatttttattttgtttcttatcttcatagataaatctagtaaccaatagtacaacgactacgaagaatatgatatatgaccaagcgatatcacttcttgtagcttcgattcccccacctatatacatagctaccaataaggcaaccactgtaaaaatgttatgaacgattttcaatgttttcatttcttccgttttttacgtttgactttcttagcgcatcggcaatgaagtaatacctgagcagcattacagtgccatttaccattttgagcatttacaggcttatcactttcaatcttacccgcttctataagattcatcaatttcttttccccacctacataatatgcagacttatcttttccgaatgtctctgtagaaaacagacggagaatattatctagcaatatttcagccatttcacctctaatcatctcaacaaacaaggtagttacgcaattctagttactataaactgcatattttttacgtctgactttgttttccaaaccattccttcagctttttctttataaagccgagcatttaaagtgtaagtaacagacgttttttgaatgataggaaatacttctattgcaccaacgtccatgtttcgcaaaacattgattatactgcgtctttctatttctttttccatactgattaattttaaaataaaagctcccccgaaccaattcgatcggcagcatcacgctttattcggaggatttacttaactttggggtgtaaaatcaaaaattaagtgaagaaattcattcattatctctctttttatctcgattaaacccgactttacaatctgcataatccccaaaagctttctgtatcatagcaggaagcttttcggctactattttagctgattttatcggcatattctctacatgcaatgagaatgtggcatcttccaaattctcattgctatcgtttttaattgttacttgaatcatgtgattattaattagttaataattttcccgttccaagattattcgctaataaaaaaggaacgggggattttcttatttttgaagtgtcaaatcaaaaaacaagaaaaatatgaataatgaagaaaaagtagtttcatactacaaagaaactttagagaaaaaaatcgaatggactttcagactccaaagcactctgttgactgttgcatctgctacttttgctgtacttgtttctttaagcaatctttcaaccaacaacgcttgcagtcgaattttactattggtggtaatatgttcaaacgcactatccatccttttttcgtgtataaccatatacgagaatcgagcaatgagcaacgtgatgatacgcaacgctcaaaaacgggtagaagaatatatcctctatagcttatacaattccaaaatgaccgtaacgccagccgtaccacgcaataaaatcttcgcaatttgtgagtcaatttcctacatttcatttctattctttattattagtttaacagcctatgcaatttataagatatacacgcagttgtaacgtcaattaaacactgaagtgatgaacggattcgaaccgccgacctcatgtagaaacatgcgctctaaccaactaagctacatcacctttatatacataaagcaaatacctcgatttgccgacaaacgtctaactgatttagttttacaacgatacggcttgaccattaaccacagcattatatcgttgagaagcccgcctacatcagtaatccctttcggcatgtgtcggcttccaaaacaccattttaccaatatgtcaaagaactcttctctgttgttcccagtctcccttcaagggcaggctcaaagaccggactgggtaccggataaccggcggtttggtttgactttagtgagggttagagaatactttggttgttcttcaaaactatgtccattaagtttcgttgcgattcaataaatttcttcaaatcatcacattgggaaactttctctctataaaatccacgttctgattctaaatctcgtttgagtttttcattctcacctctcaaagagctgatcaacgcgtctcgttcttcaatcacagcttcatatttgtctcgctgtatttctagttcggttcttttatccattgttgtataatttgattaatctccgacgtaatgtgcaccgtaatgagtactatttgggttgtagtaagcggaagcgggaatattaaggttattatattccttgctaggtgtagctttggcagtcttgctcatagcttcatgtctttcagctaaaaatttatcagttcttgatttcatagcttccggtgagaaactttcttggagttttgcgaagctccatgcagattttaaacactctgaaaatgtttttccacccttcttgtaattgcggtgtgcagacttcattatttgtgataaattgtagctcataatcgttattttttaattggttttatcaatcaatttttgtatgtttgtatgattgattgatttatgatgcaaatatatcctcaaatgtggatatataaaaatttaaaacctactttatatccccatttgtggatatttaacttttgattgattatgataaacagaattaaagaagtaataacctattcagggctatcagagaggggatttgctattaagtgtggattaaagcccacaactattaataatcaactgataggaaaaagagaaattagccttgcaacaataatagcaatttcatcctcatttgaggaaatttccgcagaatggttgttaagaggaactggttccatgctcattcaaaaagaagaaacagaaccaggaatggacaaattgaaaagtattgtatataccatagccaatttgcaggatgaaatcaatgagaagacagtgcttacccaacggcttttggaagaaaaccaaaaattaaagggtgaactggctatgttgaagaatgaaagaaatgtaggataagccatgaaaagaacatatcatagcattgttttatcaatcactttttatacttttggagtattgattgattgatgatgcaaatataaacgtatttacattaattacaaaacacaaagcttgataaataatcgtatttacgttaattgactattaattatagatatggctgaaacaagcgtaaacgaaaaaattagagagattatctcttattataagctgtcagacagacagttttccattaaaattggggtaacccaatcggtgattggttcaatgtttcaaaaaaacacagaaccttcctctaaagtaattaagctcacattaaacgcatttacggatatttcagcagattggttactacgcaataaaggcccaatgctgatttcagatatcaaacctgatccaaatattgaacgcatggaacgccttgttgatacaatagcaacccttcaggggactataaatgaacagatgaaaactaatcaattactaacagagaagttgaaaaaaatcgaaggcgaattagctatgttgaaaaatgaacgaaatgtaggataataaaagaaaataactatgacagaaaaagaaaatcccaaacaagaaacagcaaagcaagaagataacccgtctgcaaaatgctcagagaattgttcgcattatatagataaaaaacgccttcatctatacaaaggaaaattcttaatttccattattgtatgtacaatctgtatcattgcaatattcgttcttttccatttaaactataggggaagtcaaaataaagttattgaagtccaaaaggagttttacgacaacttaacaaacaaatatttaaaatctctaaccataactaaagatagcaccattagtctagatcaagttgttattgatatagtggaagaaaaacaaaaagaatcattatctttgctagagctacaatataacaaattacagcatgattttactgtattgtcgttatgggctggtatattgatgattgtattccttattttctctatatactcaatatttaaagtggatgaaatgcaaaaacaaggaagagactatttggataaaatggaagatttctctattaaggcaaaagaaaattcaggcaatatagagaaacaagcggccaaaaagattaaatcattaaatgaccaagcagatgatgaaataaagaagttgtcttttgcaagcaacaaacaattggaagagttgcaaacaaatattacaacaatccaaaaagattttgaatctagtgttgccgaaaagacactagaatttcaaaagacaattcaacaatatcgagatgaaatgaagaagacatcagaacaaaacaataaacttcttggagattttgttcgattacttgtttcttcaaattcaagtggaaaggaatctaaagattaatattatgtgctcaatagatacattacaatcaatggcgcagatttattctgacatagcgaacctgtatttaaacaaatatgaatacatggagaaaattagtgttatgcgtttaaagagagttgatttctccaattccgaaggaaaagagattcctgatatagaaatacatcctaatgatgatatctataataaaattacagaagtatttgaacatattttatctctcacattaaaaaataaaaataaatccgtttgggaaagtatttctatttaccttaactctcttaatgatatagtacaaggatttcctggatttaaaaaaagacctatcaataaagaatttgaggaagtaatagatgaagccattgatatagccaagaaaaacgaggataataatttgaggataaacattattaaatgcaaatataacatatataacgtatgaaagtttacatatttatatacaacaattctctaggtaatgaagaagaaaccaaagagttattaaattcaatcagagaaatatctgactggagaacagatatcagaaacacatttttaataaaatcaacattagaagctaatgaattggcagatatcattataaaaaacaaacctcaagcccgttttcttatttcagaaatagcagaaaatcggcaaggatggctacctaaagacgcatggaaatttataaaagattaaaatatgaaatatagaaatcttgatagtacataaaacatcaaatggtcgaattatggtcgaaccataaaaaaaagcaggactatataattgatatacagaatatataactagatttccaaaaatgtgtctagtttagtttttgtgttgatagctccctcgtcggcggacgaactagggagctatttttatatattacaggaatattattgcacaaaatatacatattttccataactttgcagcgataaagtctcacacaaatggaatatagcgtagaagaactaaaaaatgcattaattgagagatgcgaaaaagagggtattctatatgcaacggtggcaatggatagacgtaccaaagagatgattcttcctgatactttagaaggagccctgaaacatccggaatactttgtatgtacctgcaggagagtgaaagatcaatatatagtggaggagattaccaaagtgtaatcctcctccaatcttttattcttatttttctttttttattcgcccaattctcccagcaaatcgtaggaaggagcaaagaaaagcgttcctgttacagctgtgctgaagtcaagcaaacgatcggtattccctaccggattgccgatgaacatactttccaacatctgccgggtcgtactgaacgtacttgcataaccgatgaagtatgtgccatattctcccttagacgtattggcaaacggcatgttggcacgtacaattttcaggtcatcaccaatattagtgacggcattatgcgcattttgaggtttctcctcgtcagacagctcgacatcgttaaacttacgacgaccgatcactttctcctgttcttccacaggcagagcgttccatgcaaccatatcgtgaatgtacttctgtacaaaaacataacttcctcctgcaaaatcagcatcctcctctcctaccaccgcaaaatgataaggattctcatcaactgccggattctctgttccgtctacaaagccgataatagccttgccgtccatatatctgaaaccgtgagtttcatcgacaggttcaactacgccctggagcttctcgtcaatgatggaagcaaactcaaaacacaaccccatctgttttgcacggatatgaaacaagatgtcgcccggagtagagactgccgtgtgctttccgcctttgatctcttcaaaagtgttcagttctttcggctttcccttttccgggaaaagacggctccaggcatcggcgccaaagcccatcgtacaactgaacatcagttcggggaaacgattacgcatgctgcgaatcatgcccgagaaattagcgcatacatcttttactttatcaagagtttcgggagtatcttttagagtataaacaataaaaatgacattttcaccttgtttcccggctacgtcctgcgggatattacctccaaatgaattttgataaggattcatatttttctttttttctgttagtttcgtcaacgaaacagttctaattcatttttttattactatcgtcaatatatgcggcagccgctttatccacaaatagctctacattctgcgcgtgatgagctatataggctgcgggaccagtgtctcccgaattacagatttcttctactacgtcaactttattttttccggtaatcaggaaaatgacatagcgggcattctgaatggggtatcccgtcattgcgatgcgcttctgcccgttacggggatgggcgctgactacataaatagagtttgaagtcagcaaatcttcttgtccgggaaagatggaagacgtgtgtccgtcgtctccggcccccaacagtacaatatcaaattcgggccagccacgcttcaacggtacttgctgccggactaactccgaataacggaccgcttctttcgcaggcttcgcctctccacgaatacggaatacattttcatacaaaataggagtcaaacccaaaagaaggttgcgcatcattccgtaattactgtccgaatcatcgggaggcacacaacgttcatccacccaataaatccgcatacgatcccacggggtaatttccatgtattcattcgcccataaatcgaacatcagagcaggtgtgttgccaccgctgactgcgatattgaacactctgtccggctcttcattcatgatttccaccaagcggagtatcaatgctcgtgaagtttcaatagatgagggaaaaactgatagtttcataattcacaatattgatctgtattcgtcaaattcttacaaggattcgtccagtcggccccatgttcgtgcatcatcgcttcgctttccagaggtccccacgtacctgcgggataaccgtagagaggtgcgtcggggttgtctttccaataacggagtaccggatcgaaaaatttccatgaggcttctactgcatcacttcgagtaaataaagtcggatcaccctggatgcagtcgtctatcagacgggcataagcgtctccactgggtacgccgcccaactgcgcgtaactgaaatccatcgtcacctggcgcacttcaaaacctgcaccggggactttcattccgattttgagcactattccttcattcggttgcaaacgaagaatcaatttattagcccgcggacagttgccaccggcacaatgaaacatctgatgaggtgtctcacggaaatgaacgacgatttccgttactttcgtcggcatttgtttacctgtacgaatgtagaacggaacgccactccagcgccagttgctaatgcccagtttcatggcaatataagtatccgtgcgcgaatcgggagccactcctttttcttcacggtagcctttcttattgccggaggctgtatattgtccacgaacgatatgttcgttcaaatccacttcattcaacggggtgagagattcgtagaccttcaccacttcgttgcggaaattgtccgcgttgaaaacagcgggcggttccatagccgtaagggctacgagctgtatcaggtgattctgcaccatatcgcgcagcgcacctgccgtttcatagaatccgccgcgttgttcgatacccagattttctacggctgtgatttctacgtagtcgatatagttacggttccagagaggttcgaagatgccgttggcaaaacggaaagccagtacattctgggctgtttccttaccgagaaaatggtcgatacggtaaatctgatgctcattgaatacagaggcatacgttttattcagttcacgtgccgattcgagatcataaccgaaaggtttctcgacgatgatacgtgaatggggggtgttgagtccggcagctttcaggtacaagggcactactccgtacaatgacggcggagtggctaggtagaacagcaggttgtccgggtctacctcaccggtcaagtcgaccagacgttgacggagttgcgggtaaccttcttcttttgccgggtccatcggtaaatagtagagatgggagacaaacgaagccatcagagctgtgtcctgttcttcggactttacgaactgttgcagttcttctaagatataggaacggtagttatcgtcagagtagaccgtacgcccgatacccaatatagaatactctccggtcaaccgcttttcacggtagagggagtaaagggcgggcatcagcttacgcttggtcagatcacccgacgcaccgaaaattatcattgcaaatttatccatttttcaagagttgttttaatttctgttttgagatggtaaatgataattttgcggagtgccctgaaagggcttaattatatagcgtagggcaacgccctacgtaaaaacgacaatctgaatttgcgccctgaaagggcataattgtatacagttccgccctttcagggcttgtggctggtgtgtttttttcgtagggcgttgccctacgctatataattaagccctttcagggcaccccaataaatatataattgtaaggctttcagcctaactgcaaaattcccatttaaccgataaattctcatttaaccgataaattcccattaaaccgctaaatccccatttatcatttcaaattcccatttatcatttcaaaactgttttctatttaaacattatatgtacccgatttcgtatctcctccgtgacctgtccagttctcgtggaagaactgtccacgcaactcgtctttgcgctcgaaagtgtgcgcaccgaaataatcgcgttgtgcctgcacaagattggcgggcagatcggcagatgtgagcgaatagaaatagttcagcgcagaagagaaagcaggaacaggaagttcttctttcatggcttccgccaccaggtttttccatccgggaagcagcgttttcatttcttctttaaaataaggagccaacaacaagtgtttaggcttgtcggtggcttcgaaggcggcagcaatgtcgttcaggaatatactgcggatgatgcatcccccacgccacatgcgggcaatggaagccaggtcgagatgccagtcgaaagcgtcggaagcacgttgcaacacggcgaatccttgagcataagagacgagtttggaagcataaagagcagaaaatatattctttacgagttccaccttattatatataggttgtgtatgttgacactgatattgtctggaagccagatgacgcaagtctttctgtgcagaaaggcttcgttcgaataccgctgtggcaatcaatcccaacggcatgccgagttccatagcgttgatgaccgaccatttgccggtacctttctgtccggccgcatccaagattttatcaatcagataccctccggatttgtctttatgccgcaggatgttggcggtgatttcaatcaggtagctgcgtagtttgccttcgttccaacgggcaaagacatcagccatttcctcattggtcagatccagcaactttttcatcacccaataggcttcggcgatcagctgcatatcaccatattcgataccgttgtgaatcatcttcacaaaatgacccgatccggcagggcctacccattggcaacagggagtgccgtccggtgcttttgccgcaatgctttgaaggatcggtttcacttccggccatgctttctccgaaccgccgggcatgatagaagctccattcaaggctccttcttcaccgccggacactccgctaccgacgaagagaaatcctttcgactccgccagtttgacgcggcggttggtatcttcgtaattggagttaccaccatcaataagaatgtctcccggtgaaagcaacgggaacagctgatccatcaattcgtcaaccggacttccggcacgaaccatcatcattatcttacggggaatagctatcgaatctacaaatgcttttatatctgtgaatccttcgatgtttttaccttttgcacgaccattcataaagcgatctaccactccttcctctactccgggaactgtacggttatataccgatacatgccaccccttactctccatgtttaaagcaagattctcgcccatcacagccaagccgataagtccgatatctgtcttattctgatttgccataacttatatattttgaatattctgtatcttagtaacagttgaaatgcacatttgttcgcaatattttagattaaaatattatttttgtggtctacaaataaaatcaaggatgaagaagatcaaaatcggtttgttggcacgcatcgtaattgccatcattttgggtattgccatcggcacttttttcccggctccgctagtgcgaatattcgttactttcaacggcattttcagcgagtttctcaatttctctatcccgctgattatcgtcggactggtaacggtggctattgccgacatcggaaaaggtgcaggaaaaatgctgctcgtgacggctctgattgcttatttcgccaccctgttttcgggattcctctcctacttcacaggagtcaccgtgtttccgtcactcatcgaaccgggagcgccgcttgaagaagtgagcgccgcacaaggaatcctcccctacttctccgtctccatcccaccgctgatgaacgtcatgacggccttggtattagccttcaccttgggcttgggactggcgtcactgaacagcgacgcattgaaaaacgtggcacgtgattttcaggaaattatcgtacgaatgattagcgcagtcattctgcctttgctgccgctttatatctttggcatattcctcaacatgacacattcgggacaagtatattccatcctgatggtgtttattaaaattatcggagtcatctttgctcttcacatcttcctgttagtttttcagtattccatcgcggcattgtttgtacacaaaaacccgtttaaattacttaataaaatgctgtcggcttacttcacggcattgggcacacagtcttcggcagccaccatccctgtaacgctggaacaaaccaaaaagaacggggtatctgccgaagtggccggtttcgtgattccgctctgcgccaccattcatctgtcgggcagcacactgaaaatcgtagcctgcgcactggcattgatgatgatgcaaggaataccgttcgacttccccttgtttgccggatttatctttatgctgggcatcacaatgatagccgctccgggagttccgggcggagctatcatggcctctctgggaattcttcaatccatgctcggcttcgacgaatcggcacaggctttgatgattgcgctttacatcgcaatggacagtttcggcacagcctgcaacgtgacgggcgacggagctatcgctttgattatcgacaaaataatgggaaaaaaccgtgctgaaagactgtgctgaaaaataattgggtagtagcttggctggctcacaaaaaatgccgacatttgcacccacattttcaattatattaaataatagcgtatgaaaaaagccctaatttcaggcatcaccgggcaggatggttcttatcttgccgaatttctattgcaaaaaggttacgaagtacacggtatactccgtcgttcttcttcgttcaatacaggacgtattgaacatttgtattttgacgagtgggtgcgcgacatgaaacagaaacgtacgatcaatctgcattatggggatatgacagattctagttcgttaattcgtattattcaacaggtgcaaccggatgaaatctacaatctcgctgctcaaagccacgtgaaggtttcattcgacgttccggaatacacggccgaagcggatgctatcggtacgttgcgtatgctcgaagcggtacgcatcctgggactggaaaagaaaacccgtatctatcaggcttctacttccgaattgttcggtaaggtgcaggaagttccacaaaaagagacaactccattctatccccgttctccgtatggggtagccaaacaatatggtttctggattactaaaaactaccgcgaaagctatggtatgtttgccgtaaacggaatcttgttcaatcacgagagtgaacgccgtggcgagacattcgttacccgtaaaatttcgcttgctgccgcacgtatcgcacagggcgaacaggacaaactgtatctgggtaatctggatgcacgtcgcgactggggatatgccaaggattacatcgaatgtatgtggctgatcctgcaacatgacgttcccgaagatttcgtaattgctaccggagaaatgcacacagtacgcgaattcgcaacgctggcattcaaggaagcaggcatcgaacttcgttgggaaggtgaaggcgtgaatgagaaaggtatcgacgtagctaccggaaagtctttggtagaggttgatcctaaatattttcgtccgtcagaggtggaacaactgctgggtgacccgactaaagcaaaaacattgttaggatgggatccatgcaaaacatcattcgaagaactggtaagtatcatggtgcgccacgatatggaaaaggtgaagcggatgattgctaccaaacattaaatgaatttcatttcaccacagaggacgcagaggacacggaggattttattttttcctctgtgccctccgtgtcctttgtggtgaactaataaaagatagaatggaaaagaatgcaaagatatatatagcaggacaccgcggacttgtgggatctgctatctggaagaatttgcaggataaaggatacaccaatctgataggccgcacgcacaaagagcttgacctgctggatggaatggcggtccgtaaattcttcgataaagaacagccggaatatgtattccttgccgctgcctttgtgggtggtatcatggcgaacagcatctaccgtgccgactttatatacaagaatctgcagattcaacagaacattatcggagagagtttccgtcacaacgtgaaaaagttgctcttcctcggtagtacgtgtatttatccacgcgatgccgaacagccgatgaaagaagatgtattgcttacttcaccgttggaatataccaacgagccgtatgcaatcgccaaaattgccggactgaaaatgtgcgagagcttcaacctgcaatatggaacgaactacatcgccgtgatgccgacaaacctttacggaccgaatgataatttcgatttggaacgcagccatgtattgcctgccatgattcgcaagattcatttggcacactgtctgaaagaaggaaactgggaagctgtacggaaggatatgaaccagcgtccggtggaaggtgtcaacggcgacagctcaaaagaggacattctggctatgctgaaaaaatacggaatcagcgaaacagaggtcactctctggggtacgggtactcctctccgcgaattcctctggagcgaagaaatggcggatgccagtgtcttcgttatggagcacgtggactttaaagatacctataaagaaggtagcaaagatatccgcaactgccatatcaacatcggaaccggtaaggaaatcaccatccgccaactggccgaacggatcgttgaaacagtaggttatcaaggtaaactgaccttcgacagcagcaaaccggacggcacaatgcgcaagctaaccgatccttcaaaactgcatgcactgggctggcaccacaaaattgaaatcgaggaaggcgtacaaagaatgtacgaatggtacttgaaataagaaatgaagttactgtaaatatgctattagctgaattttttttgctaatagcatattttttttagctataatgataattaaattagctataatgataatcagttttgctataatgataatccaattagctataagcataatctgttgagctatgagcataatctttttttatactacgagccaatctattttattataagttaatcccttttgtgataagccttcatccaactaagcaccatttattcaattataagcctcatccattgtatttataacgtatcgccacacaaattcccccactactctctcccccatttccaaaaattcttcactcttaattcttcattcttaatataattgctatatttgcacaatttaataccaaatgtgcaaaaacaatggaacaaagttttatagcctatattgagaatagtatcaagaataattgggacctggatgccctgaccgattataaaggtgcaactttacagtataaagacgtagctcgcaaaatcgagaaactccatatcatctttgaagaaagtggaatccgcaaaggagacaagattgccgtttgtggaagaaacagctctcactggggagttactttccttgccacactgacgtatggagccgtcattgtacctattctccatgaatttaaagcagataacgtgcataatatcgtcaaccactccgaagctaaattactgcttgtaggagatatggtatgggaaaacctgaacgagtcggcaatgccgctactggaaggtatcctgatgatgaatgacttcaccctattagtgtcacgcagcgaacggctcacgtatgcacgcgaacatctgaacgaaatgttcggcaaaaaatatccgaagaatttccgtaaagagcatgtcgcttatcacaaagacgaaccggaagaactggcagttatcaattatacttcgggaacaacgagttattccaaaggagtaatgctcccctaccgcagtctgtggtcgaataccaaatttgcttttgaagtgttggaactggaagccggagataaaatcgtttccatgcttcctatggcacacatgtacggattggcttttgaattcctttatgagttctccgtaggttgccacatctacttcctcacccgtatgccaagccctaagattatcttccaggcttttgaagaagtgaaacccagtctgattgttgccgtaccactcatcatcgaaaagataatcaagaaaagcgtacttccgaagttggaaactccggcgatgaagatattgctgaaagtgcctattatcaatgacaagataaaggcaacagtgcgcgaagagatgattaaagcatttggcggaaacttcaaggcagtcatcgtaggaggtgcagcgttcaatcaggaagtggaacagttcttgaaaatgattgatttcccttatacagttggatatggaatgacggaatgtggcccgattatctgctacgaagattggagaaagttcaaaccgggttcttgcggaaaggctgtgccacggatggatgtacgggtattgtcatctgatcccgaaaatattgttggtgaaatcgtatgtaagggcccgaatgtgatgctgggctattacaaaaacgaagaagccactcaagaagtcatcgacaaggacggatggttgcataccggcgacttggctttgatggatgaagaaggtaatgttacaatcaaaggacgcagcaagaacctgttattgagctccagcggacagaatatctatccggaagaaattgaagataagttgaacaacctgccatacgtggctgaaagcattatcgttcagcaaaacgagaaacttgtcggacttgtttatcccgactttgacgatgcgttcgcccacggcctgaagactgaagacatcgaacaagtaatggaagaaaaccgcgtgacactgaacaccatgctaccggcatacagccagatatccaagatgaaaatctatccggaagaatttgaaaagacaccgaagaagagcatcaagcgttatttgtatcaggaggcaaaaggctgatagattgtcagctgcatagagaaagatataacttaaaccgaaaaagagaaaggaatgaagataaagaaaacaatacttacggcagctatactaatggctgccgtttctttaccggcacagaacaagagtgcagggatcaatatatccatctggaaagatatatgcacgcagccgcatgacagtacacagacgacatacataaacatcggcctcctgtctaccatgaaccgtctgaacggcgtgggtatcaatgcgttgggaagcgtggttcatggtgacatgaacggagtgcaaatcactggattagccaacttggcagggggtactatgaggggcgttcaactggctggtatcagtaatatcagcggcgataacaccgtagggctttctgctgccggattggtaaatatcaccggcgacagagcacagggagtagtcatatccgggctaacgagcatcggaggagacaacaactcggggttaatgattagtggtttcatgaatgtgacgggcaatatggcttcgggcttacacttttccggagtagcaaatataaccggacagagcttcggtggtctgatggcttcgggacttttaaatgtagtaggcgaacacatgaacggtttgcagatagcaggaattgccaatataaccgcatcaaagctgaatggagtgcaagtagcattatgcaactacgcaacgaaagcgcgcggacttcaaattggtcttgtcaattactacaaagaagatatgaaaggtttccaacttggtttggtgaatgcaaatcctgatacaaaagtgcaaatgatggtatacggtggaaacgcaacgcctgccaatatcggggtacggttcaagaaccagttgttttataccatattgggagtgggttccatgtatcagggattgaatgataagttttcggccagcgcatcctatcgtgccggtctgtctttccccctttacaaggggttatccatcagcggagacctcggatatcagcatatcgaggcttttgacaacaaagatgaggtcatcccgaaacgcctgtacgcactgcaggcacgtgcaaatctggaatatcaatttaccaagaagttcggcatctttgcaacaggtggatatgggttaaccagattctataataaatcgagcaattacgataagggagctattatcgaagcgggtattgttcttttctaaacttattcaccacagaggacgcagaggacacagagttttttctgcaagtaaaacagagcgataaatacgattctaaatacatgagactctgtgttactctatagtgaataaaaaatagtaaaactctgcgtcctctgcgtcctctgtggtgaataaattcagaaacgtgcaactttgagcatactgattactaattataccttttcttttatcagaccggtacgataagcaacgagcaatttcttcaaatcctgtatttgggtcaccagttcttttcctttatcggtatctttcaccatcatccgttgcgaattgaattccaagacaaagttggtagatttgatatcaagcccctcttcgatagctttctgacgagactggaacggctcgtgctgcacaagctgcataccatgagagtgataaacaagcgtatatcccgcaattcccgtttccggctgataagcttttgagaatccgccatcaataacgaaaagcttgccattggctttcattggctgttctccctgaatcgttttcacaggcacatgaccgttgatgatatgcgaatgaggaccggaagctccaaactctgccaaaatttgatcgcagacatcttcccggttacgcaatgtataataataacctttcttctctttatgcaattctttatcttctacgaaataacgctcaaaggttgccatcttatccttatcgaacaagggagcttccggaccacaccacatataccaaatgtaatccatagcaaattccttatcctcctccccttcttcatcgaaatacgcagtacgaatcagttgatcggctttatccagcaatttacgtccccaatactccttaccacgtattttgacatgcttaaagctgccatcctcattcagagggacagaagcgtgataaagaagatttgaatttgaaaccagatacattccgccataggtaaacaggcaacgcatgtgtttcttcagcttttcactattcataaatgaataatgaatcttttctaccaattcgcgttcttcttccgtcaaccggtaaggatcggcaggatctacggtagggaagttggtatcgcgcaaaacatattcttttccttcgtatacaaagacgccacgctcaaaatcaatcttttccagcagtttgcggttggtcatcccaaactccggacgacggtcgatgatttcggcttccagcttaaactggataatggtaatggctttatgcatttgagtgatcaagcgcagagtcttctcattataatgagcgtcggcaaaattcatcttcggcatgaagatggtgcaaggatcatcggcatacgtatccattgcaaaagtagccaatggaagcagattgattccgtatccgtcttcaagcgtgcccaggttgccgtagcgcatggacatacgtatcacgttggcaatacaactatcgttaccggaagctgcacccatccagagaatatcatgatttccccattgaatatcgaagttatggtaattgcacaacgtatccatgatgatatgcgcgccaggaccacggtcgtaaatatcgcctacgatatgaagagagtcaatagtcagacgctgaatcagattgcacatagcgataatgaaatcgtcggcacgcttggtagtgataatcgtgctgataattacattgatataagcatgcttgttcggctcgatggaagattcgtgcaataattcctgaataatataagagaactcggcaggcagcgatttacgaaccttcgaacgggtatatttggaagatacattctgacagaccttcaccagttggttcagggtaatcagataccaatcatccaggtccttttcacgggctttcactaattgaagtttctcttcgggatagtaaatcaacgtgcagatttctttcttttcagcctcgcggagagtgttgccgaatatttcatttactttacgttttaccgcacctgaagcgtttttcagtacgtgctgaaaagcctcgtattctccatgaatgtcagtcaggaaatgctctgtccctttaggtagatttaagatagcctccagattgattatttccgtactagcatcggcaatcgtaggaaaacttcgggaaagcaattgcaggtaacggagatcgcccacaatgctttcaggagttatgttactttgagcagtcattttatttactattttactatttacaatttactagttactaattacgatccagcaatatactattctcaatttaacaagaacatcaacaacacttgggcgataattacccgcaggaacatacatagcggataaacagtcgcataggctacggatgggttgtcgccggggattgtatcgtttacatagttcagtgccatcggatttgccatacttccgcacaacataccggatacagaaccgaaatcgatcttcatcatcttgaaagccacgaatccaaccaacactgttggaatgatagtcaatccggctcccaaaccaatccataataagccttccggacggaatacggtatcgaaaaagtgagctccggcatccagtcccagacaggcaaggtacatggaaagtcccaaggcacgcaacatcaggttcgcgctacgggtggtataggtaatcatgtgtatccgtggtccaaaagtccccagaaggataccgacaatgatcggtccgcccgctaatcccaacttcacaggagtactgacacccggaaaagagaaaggaatagcccccagtgccaaaccaagcacgataccgataaatataacaaccagattgggttctttcaggcttttcacggcatttcccaatactttctccacattctggatagcagcagcctcgcccaccactgtcaggcggtcgcccagctgaagtatcaatcccggagtagcaagcagttgcacccccgaccggtaaacacggctgatattaattccgtaatggtttctcaaccggagtgcaccgagtttcttaccattcagttcgggacgggtgacaacgatacgctgcgagatcaattcgctgtcaatcgcattccagtcaatgtcctctttattccaatccgtattttcctgttcaccaaaaagcactgtcagggccaaagcgtctttttccgcagttaccaccagcagacggtcgccttctttcagaatcttgtctgaagtcggaatactgacatgtccgtcacgccacaaacgggatatgacaaacttcgggtaactcatacgagctatatccttgatacttttattgaaaatagcaggattgtgtacttgaaacgctgcaatataagttttgttcgcatcgtctttctcttttatctccaaatcttctttgcgaaccaatactttacggattaataaaacggcaaggattacgccgactactcccatcggataggccaccgcacatcctaaagcaggcgtactgctgtttattcccatctgtttcagagtttgttgcgcagctcccaatgccggagtgtttgtcgttgctccacaaaggatgcccaccatatcaggaagagagacacccgttgcataactagccaccaccgtcaacaacgttcccagcagaacgactcccaacgccaacatattcagcgttaccccacctttacggaaagagctaaaaaaaccgggaccgacttgtagcccgagggaataaacgaaaatgaccagtccgaaactttctgcgtagtttaacatctgcggatcgaccgaaagcccgagatggccggccaggatacccgcaaaaaaaacaaaagtgactcccagggaaactccccagaaatgcactcttcccaagcccaaaccaatggcagaaatcagtgaaagtaccacaacagcctgtaaggcagaatgttcgataaatagactatataaccactccatgtatataaaaactaatagggcgcaaagataaaaactatttagtccggttcaaaacttttaagctttcatttcgcgccctaattataccctgattcatatatcctgaaatcttattgattacccttttacactgttacctgttattttgttcttaatatctgttatatttctatcttaacaatcttatcctttctctttttacccgcatcttgttatccttccaacgatgcttttttacctgtttcttcctttacgcttacctatttctttatctttttctaatttctttatctctcctaatttcttaaccttttcttatttcttcctgcttcacgtttctccctgctttacgtttcatcttttcccttgaaactccacaaagttatttcgtccgtccagataaccgttcaatctgtttccaccgatatatacatcatccaggtatgaaacatcattcggtccgtatgacatacgaatggaagtctgtgcataattttcccaactccaacggaaattatattcatattgatcgactgctccattaggatattccacccgtatatagtcgattccggtacggtctaaaaagaagtccagttcctgacggcaatagttaccgtccatgtcgcggtagaaactaacccaggtacggctacataaatcagccgaacggttatagtaccctgcaccattattatcatcatcatagaaactatctatttccacttcgcaagaggtaaaacttaccatcaatatagccatcaacgccaaaccgaagtatttaaatgtgctcgttttcatattcctttatttttaatggttctctaattattatatatcatttatctttcgatagaacaaaagtagagaatgaattttccccatgaaactgaaaactcctacttatcaggaggaaattgcctaaatctaggagtaaatccctccggtgaagtctatttcaaagaattcttgtatctttgcctcccactaacaacacatgaaattatccgtcgcatgaagtctatcaaatcacatatcacccaattattgaagtccctcaatgagggagtattcgaaaaagagcataccatcgcactgtctttactatccgccatggcaggggaaagtatctttctgctgggccctccgggagtagctaaaagtttggtagcacgtaggctcaaactggcatttaaagacgcagatgcttttgaatatctgatgtcccgcttcagtacaccggacgaaatattcggccccgtctccatttcaaaattaaaggatgaagatacgtacgaacgcatcacaaaaggatacctgccgacagcatcaatcgtctttctggatgaaatatggaaagccggccctgctatccaaaattcccttttgacggtaatcaatgaaaagatataccgcaacggacaatttacggtgcgtgtacccctgaaagcattgattgccgcttccaacgaactgccggcaaaaggtgaaggactggaagccttatacgaccgtttcctgatccgtcagtttgtcggatgtatcgaacaggaatatgcgttcgatcagatgatttcttctacgcgggagatagaacctgaaatccctgaaaagctccaagtgaacgatgaattatacaaccagatacaagctgaaagcgaaaaagtaggtattcactataccatcttcgagctgattcacaatatcaaacgagaaattgaacaatacaacacaggacgggatgaaaacacccctcctatctatgtatccgaccgccgctggaagaaaatagtaggtctgctccgcacatcagcctatctgaatgaatctccgggaattcatttctccgactgcctgttgatgagcgcctgcctatgggatgaaatttcgcagctccccattatcgaagagattgtagaacagtcgatagcacgaggcatcaacacctatctgttaggagaaaaacggctggaacaaaaactggacacactgaaagaaaacatgaagtccgaacacagcctgcgtgaacttagcgatccgggaatccaggtcgtagacaccttctatcatcgcatagaaggttatcacattgccggaaacctactcatttttgcttccgattaccagtctttgaagaaagacagcaaccggctgttttatatccagcaggataaattccgtccggtcaacaaaatcctaaaagcctacgattttgtaaaaaacagaaatatcgcgcaaaagaatatctattccctccgaaaaggaagacggtctgttttcgtcaacaatcaggaatatccgttactatgttatgacaattgcgaccctttgcccgcacaacaggatggcaatactccgttcgaatttacattgcaggaagtgatcgacttgctgcatcaaatggaagtggaatataaaacaatctccgagcgggaaacagcatatacaaaagagcatctcttcttaagcccatcgcaaaaaagcaagataaaacgcatcttaggagagactgcacatatcatagagaattaccggaacgaactccgcatcatcgctcatgcccatgaacaagagaacagagagtattaggctcaaacacctgcaagacatttattatgagaaattgcaggaaatagcctacgatgtgtacgacgaacaactgcacaacctgattatccgtcccgaagaactggatgcggacattcaccggtattttcgtcacacgcaaccctccctgcaagatttctactcccactacgcgtcgcaatgggaatactttcatgaaatgaatgaagcatccgacaccaagtttctccaattcctaaaaaacagcgcctacccgttctcgatgaaatatcacctggtagacctcaacgtaaaatactacctccagcgttttgacgcaatcagcccgcgctctaaagaatggaaagcgttgcggactctcttcttcgacaaatggcacacactgctctcgaacaacgagttcaactatcagatggaacatatcgagcggctttgtgatgatttctaccgtcttcagctatcacttgccaaaaaccttccggtgcgtggcggctcacgcctcgtctggttactccgcaaccataaacagatagcagaacagattttagaatacgaagaaacgatcaaacgaaatcccgttatccatgaactggtagaaatcttaggcaagaaacaccaaagcagccggaaacgtttcaaaatgactgccggtattcatcgggaacaaattatatctcatgccacccgaagtgatattgcaggtatttgcgaaggaaacgacttaaacagccttcttcccttggaatattgttatctggctgaaaaaagcctgcaacccattttctttgagcgtttcattgagaagagattgcaagtcatcgactatcaatcacacgaaaagcaaaccatcaacgacaagaaaacaatagggaacgaagtttccgaagaagccgaaggccctttcattgtttgtctggacacttccggttccatggcaggcgaacgggaaagaatcgcgaaatccaccctacttgccattgccgaactgacggaagtgcaacaccgaaaatgttacgtcatcctgttttccgatgatatcgagtgcattgaaatcacagacttaggcagcagtttcgatcgcctggtcgatttcttatgccaatcctttcatggcggaaccgatatggaacctgttatcacacatgctttgcgaaagatcagcgaagaaggatatatggaagcggacattatcaccgtatcggactttgagatgcgtcctgtcgatcaactactatcccgaaccatcgaacacgcaaaagcgaaacagacaaagatgtacgctatttctttaggtggcaagagtgccgagaccagctatctgaaattatgtgataaatattgggaatatagcattcaaaacgccgaaagtcttaataaaaatagaatcgaggaatcaaatatttaatcaatgttataaaacatctcttttttcttgttttatttgcaaagttgacagaagtccgtatatttgtactgtgtttttcatagtattagatttaaggttaacaaaaagattggctgtctgggatagatagcctttttttatgtccttttcttacgtcaaatataccgtcactatcccatccggatatttaccctatcccatgaagataccgtcactataataagcggatagcgtcaatatgtttcaagttcccattccatcgataaaaattaaaagctttcgaaaaaaaaaatcttccgtttaacatttgaaacatagcaggttatctcattttacaaaaaacaggtaaaaaaaatcttgctaaaagatttgcgtagtccaaaagttccccctatatttgcaccgcatttgagagagaatgcgggttcaaggaagtttgggtgagtggctgaaaccaccagtttgctaaactgacgtactcgtaagggtaccgggggttcgaatcccccagcttccgcaaaaaatctcaatataaaaaagagctaagttttaaagacttggctctttttaatctatcaaactccggtgggttcgtctaacggttaggacacatgcctctcacgcatgtaatacgagttcgattctcgtacccactactatctgattatcagcctcttactagcaagtaagaggcttttttattgccttatatttatctcaaaatatcgtttttaagcgatataaagaggtattttcaaaagaaaaatgcaaattttgcgcaaattttcatctcgcatagttatcgtgctatcccattaatgtacctacctataaagaaaaagaggaaatgcagctaaactacatttcctctttttctttatagatctcaaagtaagattctttatctattctcaaccggactctttcttccctcttctgcccggccaggtttacgaacaagttgaaatacagttggctgaaagaaaggttggaacgatcataggttatatcaaacgtccaggttctacggaaagaatcgaaagtagcgaatggttgctcacctcctttacacataaacacttccgggaaagacgtaggcggataaggctggaataagcccgctaattgggcatacacatagtcaatcatccattcgtctcccgttaaggtcagttcccctttcaagcggagtttgatcgcataactggcagtcacgtcagacgaggtataaacagggacttgactttctaccggatagttaccgtctttatatccaaggctcatcgttagtttagaccggccgacgccattaaaaccatctacttcctgatccgccgactgatttttcaggttaatcataaatgtcagtttaccgagagtcgggtcacccggatattgcgcaagcgtgtccaacacataatcttcggtattataacttcgggctatcaaatctccctttcctgcctccaaagccggaccgcctctttccacatccacgttgccaaccggataataaatagcatcattatccctaacgcaaccactcaaacaaaacagcaacactgccaagcctattatcttattcataatcaccttacttcttgattttgcggacaaagatacatcttttttataccacccttgatttatgtcaaccgtttttagtatttttgcacacatcaagacagaaaagacatggatacactattaagagagactgtaaatgctgttgtcaattcccgctttccggagatgagtatagaaggaagacggcagatagaaagcatactgattcgtgaagaattccccaaaggagccatagcgctaaacgaaggagaagtagcccacgaacttgtttttgtaggaaaaggcatgcttaggcagtactattacaaaaacgggaaagacgtgaccgaacatttctcatacgaaggatgtatcgtgatgtgcattgaaagttttctgaaacaagtacccacccggctaatcgtggaaactcttgaaccttccattatttacttattcccccgcgacatgatacaaaaattagcgagggaaaactgggaaatcaacatgttctatcaaaagatattggaatactctttaattgtatcacaggttaaagcagactcctggcgtttcgagtccgctcgcgaacgctataacctcctgctcgaaacacatccggaaatcatcaaacgcgcgcctctggcacacatcgcttcctatcttctgatgacaccggagacactaagccgtgtacgctccggcgttctatgattttagcggcttttccggtattcttttggagacataccggtgtaatgcttgaaatatttcccgaagaaagactggtttgcaaaattcagccggtcggcaatctcctgtatattcatacttgaagaattcaggagggctttcgcttccagaatcaccaactcatcaatccactctcccaccgtttttccgctgacttctttcacgactcccgaaagatgtttcggcgtcagacacagttggtcggcatagtattttacgctgcgttcagactggtaagactccaccagagactcataaaagcgttcgaagatatactctttccggcttttattcttcatcgtagtagcgtttgcgggtgcatgattagtgaaaatagtgcaaagctcgaaaaagaacccctgcatcagtcccattaccacttccctacgatataaagcttccttattcctcaaccgtttcctgataaacgcgtgatactccttcaccacctcctgctcgtgcggagtgaggtcgaaacacggataatctttcagatagaaaaacaaagaaagcacatttccgatcttaggcaacgtctccagcaagttcttcgacacagcaaagaaaatgcctttaaaatcgtgactgaaataccgctgctcgataatctgattaggcagtgctatcaccatcaatccgggacacaattgaaattcacgcaaactaatcttaaaagtaccggtaccctccagacaaagccccaccgtcaacacttccagtttggtaggcccgttatacaacgatataacgctctccgtatcgaaaagcgctatatcattatcaacaacatcaatgttgtcggcatctatatgtttagaatgaactaccgaagaaatacctactttcggaacactttgaatatccatactctctctctttttggcgacaaatataccagcatttaatcagatatacaagccaatcgggagcattatcggacataatgaacacttttagatacttatcgaacagaccggaacagatattcataatcacgtttggcagccggcaccgtccacttttccggaacaaacttccactgattgagcgctttcgggttcatcgttcctttctcctcaatgtaattcatcaggtagaaacggagatccttatccgtagagaaaataatgcggtctttcaacttctcctgcgggatgcccgcccctttcgtcagcaattctccgccaccattgccacggtaagaattcaaggccaccttatatatcttatccatgcggaaaggagaaccatcagccatgcttttgatcgttatcttctcgccctgcggtttagtgacatccaccgtataaataatgcccgaagccgagtcgaaattaaagctataattctggaaagacgctctatcctccgcaccttcacgacgcttctccttaaaccagagcagatgatcttccggcgatttcatccggttcgtccacatataataagacatctccaagaaatccttaatctcctttccggacagagtcatcacatacagcatgttctcatacttatataaattgaacatatcactcacaaatacatcccccttctttatttccgagtcaaacgaaagcggagcggcaaacgagatgtcggcaccggtgatgtcgagctgcaaggtatgtatcaggtcgataaaggcagaagggccgaagaaagcaggatgagtggagatactttcggtaaaagtgccgattttcttcgaaacgaacttctgcaccgtttcatattgcggggcaaaacgcttcataaagtcctcgctgattccgtaagcctccgtttccgtcaagacacccttgatgtccttgctctgcacctttccatctttcagtttcaaggtcacatctacattagacaaaacgatcccattgctggccggatcgataatcaacaccgagtctccggcaacattcatcaccttcttacattcgcgggaatgatcgtgccccatcaatacgatatcgaatcccggcacattcttcgctacgttgagagaagcgttctcgttgtatttgcccgacattttgaaagcctcctgtccggcatgaaacaagccgatcaccaaatccgggttctctttttcacggataaccttcatccatttgcgtgccgtctcttccatatcgtcgaaacgcaatcctttccacaggttttcggagagccatgcagggatggcaggggtaatcattcccaataccacgatcttcacaccatcacgttccaacactttgtaaggagccagatggggctgtcccgtagatgtatctatgatgttggcacccaacactgggaaatcacaagtggcgatccaacggtcgaaaacggcacgtcccgtttccacgtcatggttacccatgttgccggcatcatacttcatataattcatcatttccgagcaaagatggggagacaccgtatctatataattatagtaataggcagtgggctgtccctgcaaaatatcgccgttatccagcaatatcagattctccttatattgttcgcgctctttctgcacgaaagaataaacccgtgcgagactccccttccattcgtggcgggttataaaattataaggataataattgccatgtacatcacttgtttctacaatcttcagtttcaccaccttttcctgcgccgcaacagacagagcgaggcagagaagcaagccataaattaatacgattcgtttcattctttttctatatttagatttaacggatgagagaatacaaaccgcgccccaccggtatagtcagggtcgatccatatacttcctttccatttgtgcacaatcaatttacagatagacaatcccagtccggtaccctgggcatattcattcagtttctcaaaacgctcgaacacaagtccctgtttttctttcgggataccgcatccggtgtccgtcaccgagaagacagccatttgcgtttcctcgttcacagaaaagtccaatgtgatcttaccgcatttcgtaaacttgttggcgttggacagcaagttaatcatcacttgctgcatacgctgcacatccgtcaccatccggaaagattcgaaagaagtggtaaacaagaactggttttccgacgactgccgcgaaaaactaacagacgctaccacctggctgcacaactgcaccacatcacattcctcccaagtcagcgtcacccggttggcctccagacgtgaaaggtcgagaatatcgttaatcagtcgaagcaacaaatccgaattggttttgataatctgataataagactgctgttcctcctccgtgctaccgccaacggccaatacatccgagaatcctacaatcgaattcaacggtgtccgtatctcatggctcatattggcaaggaaagcactcttcagacgattagactcttccgccctgtcttttgctacgcgcaagtccttctccgatttcagcagctcatctttcaggcgtttcgtacggaaataatagaagagagagatgcacaagccgagcaccagaatcacaaacaaagcacaggcagaccatatctgataagtatattgctgatagaacgaaaccggctggttgacaagctgcactttaaaaggcaataccgccgggtccagcccccattccttcaccttccggctatccaataccgctttgcagccgattaccgaaagatgtttcgccgtatcctgcgggtgcgtatccatctgtacagactccatagccatttctccacccactttccggtagtcgggcaacacccctcctatcgcccaatgaccgagactcaccgatgaaggggtaaaagccggaatggtaggggtaacttccatcatggcatacgtggcatttctcatgaaatacccctcgttcatatccacccgccacgttcctaccaggatcaccgtgttttcgggcagttgcctcaactcctcagcgatggtataaatagaatgtttccgtccatccatcagaatcaaatccagatcggggaatttcttcatttcttttcgcaccaatgcttgcatggtcactccgccatacgtgttgtccgaaataaaggcaatgtgtttcgttttcggatagaaggcttgaatcatctgaatattaccctctatatcatattggttgataaatcccgatttgagttcggggatattcagatggtcgtcgaagagatcgactgattcgggcatccagctatccaggctttccacggtatcttccggcaatatcaccacgttgctactggccagactgcacatcacgggcactttcacctgcatttcatcccgctgcgacaaataagcggcccatgcttcctgacctaacaagataatctgcgccggatgcttttccccttgatatttagcaagaatctgtgtcatcattttgctccatagcggagcttccgagaagcttttacagttcatattctcgatgatgatgtcgcgctgtcctcccaacttactatattcatccatataatcagaaatagtgaccgatgtttggtgcgctgccggattataagaacagataatcagaataggtttcttatcgttagagacagccaagaccttcgatgactgcaggagccaaagaaaacagataaaaaaatatccaagacgtcccagcataataatgcagttttgatgtgttaattcattaattgagttgcaaatatagtaaaacttgtcgggtttaacagatttatatgtatttttgtcgctcatttactgtcaaaaaatacaaattatggaattatttcacaagatgatttccggatttctgggcataccggaaagacaaataagcagcacgctccatcttttgggcgaaggtgctacgattcctttcatcagccgataccgcaaagaagccactggcgggctggatgaggtgcagatagagcagatcaaagagcaacacgataagttgtgcgacatagccaaacggaaagaaacgattctcggcaccatcaccgaacagggcaaactgactgcggaactggagaaacgcatcaacgacacctggaacccgacggaactggaagatatatacctcccttacaaacccaaacggaagacacgtgccgaagtggcccgccagaaagggctggagccgcttgccaccatcctgctgttgcaacgggaaaacaaccttagcgccaaagctgcttcctttgtaaaaggtgaagtgaaagatgtggaagacgcgctgaaaggtgcgcgtgacattatcgcggagcaggtgaacgaagacgagcgtgcccgcaacgcggtacgtaaccagtttgggcgacaggcagagattacggccaaactagtcaaaggaaaagaggaagaagcagcgaaataccgcgattatttcgatttctccgagccactgaaacgttgcacgtcccaccgtctgctcgccatccgccgggcagagtcggaagggttgctgaaagtgtctatcaatcccgacgacgaggcctgcatcgaacgtttggaacgccaattcgtacgtggcaacaacgaatgtagccggcaagtgggcgaagccacgacggatgcttacaaacggttgctcaagccttccattgagacagaatttgccgcccaatccaaagagaaagccgacgatgaagcgattcgcgtattcaccgaaaacctccgccaacttcttctcgctccgccattgggacaaaaacgggtgctcgccatcgaccccggattccgtaccggatgtaaggtggtttgtctcgacgcacaaggcaatctgttgcataatgagaatatctatccgcatcctccaatcaacaagaccggcgaggctgcttcgaaacttcgcaagatgattgaggcctaccagatagaagccatctccatcggcaacggaacggcaagccgggagacggaagatttcatcaacagtcagagtttcgaccgccagatacccgtgtttgtagtcagcgagcagggggcttccatttattcggcttccaaaattgctcgtgacgagtttccggattacgacgtaacggtgcgtggggcagtctccatcggacgccgcctgatggatccgttggcagaattggtgaagatagatcccaagtccatcggcgtggggcaataccagcacgatgtagaccagacgaagctgaagaaagcactcgatcagacggtagagaattgcgtgaacctagtcggggtaaatctcaatacggcaagcagtcatctgctcacttatatatccggtctgggcccccaactggcacagaacattgtcaattaccgggcggaaaacggagctttcagttcgcggaaagaactgatgaaagtgccgcgcatgggcgccaaagccttcgagcaatgcgcaggatttcttcgcatccccggagctaaaaatccgttggatcataccgccgtgcatccggaaagttaccacatcgtagagcaaatggccaaagacctgaaatgcaccatcgacgagttgatagccgacaaggaacttcgccggaagatcaatatttccgactacatcactcctaccgtcggcctgcctaccttacaggacattctgcaggagctcgacaagccgggacgtgacccgcgcaaggctatcaaagtcttcgagttcgacaagaacgtacgcaccatagccgatttgcgcgaagggatgattcttccgggcattgtaggcaatatcaccaatttcggggcgtttgtcgatataggaattaaggagaacggtcttgtacacctttctcaattagcggaacggttcatttccgacccgacagaagtggtgtccatccatcagcacgtcatggtgagggtgatgaatgtagattatgaccggaaacgaattcaacttagcatgatcggggtaccgcaagactgattgcttctcttttctctccccaccacacgatcagaatcgtaaatacaatcataagtactgtgcaaatgagcgagccttcaaaaccgaaggctccgccattcagtacgttttcttcgggcatacgcaaagtcagcatactggtggtgaagttgtttccgcttacctgataaccgaggatggggccttgaatccaattccagaaaagatgaagcgagatagggaaacacaggttccgcgtatatagataggaagctcccagcagcatacctgccagcaacaggttgagcataggcaggaaagctatttcgggattgaagatgtgcataaaggcgaataacgctgccgagatgaaaagcgccaggaatttattcatggtggtatgcaataggcgtccgaggatatagccgcgcatcagtatctcttcgaacaaggcgaccagcaggaaaaacacccacgagcccagcagatccaacggcttgaactggaaaccggtgacttctatctctcccaagacgaacgagattccgaagccgaacagatagagcaggattgccatcaggaggccataccacagtcccttgacgtgtccttttaaggagagccccaaatcagaaaacggacggcgttcgaagcggagcataggaatggcggcggtcagaacggcgagcagcatactggcttcgaggataatgtatcccaccactcccggatggcgggcttccacacccaacaccaacgacaaacatccgcgggccagcgtaccatacaatccaagaaggatgaaaagtatcacaataaacagcgggatacaagcccacacaggaagtcttttgggttctttgcccccagcaatgttgtctgcctccatttttacaatttgttaatccggctacaaaattagatataaaacataaaaaaacatcatgtattctctatttttcctatatttgtcagaacaaatctacaaaattatgaaaataaaactactattgataagtttcttattggccgctaatgcgttaggagcagccgcccaagtgagtaaaacgtattatgtgagtaagcccggtacgctgatttccatgatgactgaagaggaagccaacagtgtcacccatctcacactgaccggaaaactgaacgcggaggacttccgccatctccgtgacgaatttgataatctgaaagtattggatatttcgaacgctgaaatcaagatgtacagcggaaaagcgggcacttatcccaacgggaaattctatatttatatgccgaacttcattcctgcatacgcattctcgaatgtggtggacggagtgaccaaaggcaaagccacgctggagaaagtgattctttcggagaaaacaaagaatatcgaagatgccgccttcaaaggttgcgagaacctgaaaatctgccagatccgcaagaagacagctcccaacctgttgccggaagcgttggcagacagcgttaccgctatcttcgtccccctgggcagcagcgactcttaccgctacaaggacagatggcagaactttgcgtttatcgagggggaaccggtagagactaccctgcaagtgggcgccatgggcaaactggaagaagagatcctgaaagcgggactgcaacccagagacatcaacttcctgaccgttgagggcaagctggataacgccgacttcaaactgatccgcgattatatgccgaatctcgtctctgtcgatatttccagaacgaacgcaacggctatccccgacttcactttcgcacagaagaagtatctgttgaatatgaaattacctcataatctgaaatctatcggacagcgggtatttagcaactgcggtcgcctttgcggcacgttggagctgccggccagtgtgacggctatcgagttcggtgcttttatgggatgcgataatctccgctatgtgttggctaccggaaataagattacgacgctgggtgataatttgttcggggagggagttccgagtaagttggtttataagaaataaaaaatcccctgatatgaattaaaccgcttggttattcatatcaggggataaaattatcttagcgagtatgagattctttcttactgacttgcttctttttgctagtttcatccaatgagtatttattcgctctcactgctatcttatatccgagaaacattcccagtaaaagtaacattagataatcaaataatacagatacccgatctaaataaaaaattgcatacgctccaaaaacataacaatagacttgcattattattttatctgatttcaaataaaatgtccgaatgattccttctgctttcaatggtcgtttaggagtccgtatatagggaaataaataactcatcattccgcctattaatgtaatcgcccaaaaaattaagaatattatctgtacactggatgacagataaggaatcttatatatataaggcaagaagatacgataggcaattaggattatactacctaacaaagctgttttttcatatattgctattaaaagatatctcatatatttataaattaaaagtttattttccaatcaaaatactcctcccatatagttggaccatatatttcttttttttctacttttttcgtatagacttcataggaatcttgtgacgggtcagggttggtaacgtctaatgtttccttcgagaatgttcctataaccccaagaatcatgcctaccattgttttctttcctccatcttttggatttcttttcggagccggatcaccattaggcatcacccccgacacgttagtatcaatactttccgccacattcgcctgattccggtccaatccttctttattcctcctgtctctttttctttgatgctcatattcaggactaatcgcattctttgcctgataaaataaaagagttccaaaggcataagacattttaggagcattatttataatctgccctaattccgcgaatttccctgatgtatatctcattatctgttgatctgaaggcaatctataagattgtgtgttcgtcaaaggataatagaatggcagaggaagaggagttccattttcatagatcacattaccgcaataatcggtagtagttgtatttcctgcgatactatgaacaacacgtagtttagtgcctgtgcatcataaaggtaagaaatagagctgccatcttcgaactctatacggttcggtaaatttaggtaattatattgaatattgattatctttttatttaaatctttcgataaattgtcgttgcatcataatagcactacacacactatttattccttctttacctaaactgggctaagtaagtaaagttatcaccaataaaagaaattaccctgatataaattgatgattagccaacttatgtcagggtaaaacaagataaatattctatatcaactattctttagaaaaataatcttctggcaaatttgttacaaattggatcatttgaatatctctatttagaagaaaagtatctaaagcacaacctagtttattcagatagatactttgttttattctgctttttgatggagaatatagctgatatcctctgtctctatcatatcttaaaaggcagggttggaatttactccgctgcatagtatctgttacatatttatcacgtatttcttttcttatgatataaaattcttcttcgtaatcaaaatctttactgcaataacccgaagaattataaaaataagtaaaaagagaacttttcttttttatcatttcacataaatcaaatttaaacttcatccattttttacctttccaaaaaacatccattgattcgttctttatttcaaatgaaatatcatccttatgcatggataaatattgcaacaaatcttcgcgtcctgttctttttttattaatagacttttcaaaatcactaaatgatgagaatgtgttatcattagcatcatctatcattttccaacaaaaattcttcaattcctcgacagatggatatttcaagttggcgcgataataccattttacatgactatataagtcaaacttaaagtcatagtcaatagaattaccaccttctgaaggcagacttttgcagctatatataactagaaaaagtcctgtaattgcataaactaaaaatcttttcatttttctctattaaaaaacaatcggttatatttatcaactaatgtattggctgcagacttagaatattttagatgaagtatatcaaccccttttttattcataaatctaatatggtaagctttttgcccattctgccaacctccaatatctttcggcatatctctgtctccaacccaattttccatataccctttcattgctcctttaccacctaagacattatacaatccactactacttccttcatactctatattatattcatttctatgtgtatcaagacctaaatatctagattcttttgagtttattccttcaatagagaagtctgtagttggatttccagtatcttctcctccaaaagaattattcacttttttctctgcaatagcagatgtcaaaattgcattatcaatcttctgatacacagcaccctcaaaagagtctgccacttttttacttccgaataaactataataaatattattttccgtatgtgtaactcctaaatacattccatttctcactactttatttaaatctttctgcgagtgaatatctgcgctataggaatatttccaaattccttcttcattttgaactttataccaatctttaccatctggatcaatatactttacaggattattcgcacaataattatatggacttactccataatacttttcacttgatggatccatcacatgccatcttcccaatgccgcatcatacattctcgctccataatcataccaatccagtccgccttttctatccagttctttcccattgtacttgtaaggctgaacagaggaagttgaagcaaagataccgccaaacggataataatgattcacttcttccactgctccatcctgcgataccactacccgattgttaccctgatgatcctgtaagtaataatgatacttattatcattcaaagatacgaatccggcatctgtcaataaagtcttaggagtcccattttcatagatcacattaccgcaataatcggtagtagttgtatttcctgcgatactatgaacaacacgtagtttggtgcctgctgcatcataaaggtaagaaatagagctgccatcttcgaactctatacggtccggtaaatttaggtaattatattgaataccagcaatctttttattcaaatctttcgataaattaccattggcgtcatagaaagactctatactctatttaactacgtttttcatatctaaaaacggaatcgagtaagttggcttataagaaagttcccctgatgcaaactactctattatgattattttgcaccagaggaagattctaagctttaaaaatataagaattaccaaacttcaagccaataaaccacatagttcttataaaaagtaagccctttagtatagccatgcaaccatctttcaggtaagccaatacctgatctagaaagatgatcttttttcaaaaagcgacctttttctgcatttagaacatacaggacggcattatcatagaagtcggaaggaaacttgctctcccaaagacgaaaattaggaatgggtaatacatcaatagattcacaattttgtattgaatctaatgtaactatctcaaaagtatcataattataaggaataaccattaaacaggaatctttaatatgatatacctcttttgcctctagagtcacttttttctttagtttttcaatatccgaatcttcgtaagatattgccaaatgaatatagcttaaatacttaccacgtggaaatgtcaacgccataagtccgatcttcttgtcatctatttttctgggaaaatgagatacaagagattttggatataaacttattatctccttatattcccgtttatcacgttcatcagggacagtttgagataaacaattattaaaactgataaaaaaagaaacaaatagtattagtattgttttcatataagttggtttataaaaaataaaaaaagaaattaccctgatataaattaattattagttaacttatgtcagggtaatacagagcataagtgagaataataacataaataatatctaagtttagaatttttcattttatatcctttaataataggtataacaatctgtgctaataataatggtaaagtaaaagttatattcttcatgaaagaagactcgtactcatagaaaaacaacgagaatagtatttttataagacatagaatatacagcattttttgtatatacataagatatttaccaactcttccaaaagacgtcatctaatttatttttaataggttcaagtatatcataagcattatgttcttcgtttatttttgattgggtgcctgttgcagcattactctaaacatactatttatttttaatttcttgtcctcttagcgagtatgagattcttccttactggcttgcttccttctgctagcttcatccaaagagtatttatttgatcttattgttatcttatatccaagaaataatcctattaaaaacaataacaaataattgtataatgtagacttatattcaatagaaaaagttatatataccacaagaaaccaacaatatgcttgtgttattattctatcagattttaaatatagtgcccgaattaaacctttccccttcaatgaccgtttgggaatctctatataaggaaatagataactcatcattccacctattactataatagctaatgcaattgcaagtattaccctaaaaataaatattagagtaggatattcaaataaaaaagaagaaaaaatacaataggggatcaccataaaactgaaccacagaagtgattttttatatattgctataaatagatatctcatatagtaataagttatttgataaaattagttcatttattacataccatcttgtagcttatatccctcgacgtgaattcaccataccttggctattcacatcaaggggtataatattgaagtttttaaggagtattttttttatttgcttgatctactatatatcggttagctcttattgctattttttttccaaggtatagtccaaacagaagtaatattaaataagctattgctttttcgtgcctatagaaaactagatatattgcaaagaaaacggcatatgtcatatctatatcctgtctaaatttcaaatataaaaaatcaacaatattatttattttagtattcttttcttttcgctctttattacttatcaataagtttaacaccttacctatcagccatgctatccacgatattagcaacaatattacaaccatatacatatagtcaaattctccaaaatcaggatggaataaacaatgaactatcattaaaatactattgagaatagtaatcttcttaaatatcagtataaaaatatctcccatatatcatttttatttaaataattcttttatccaattataaatattccctacataatctgtcgaatactcttttttaccttcaacttgatttgtatgagtttcataagcatcttgagtgggatcaggatttgttagttccatacatgctctatctacagctagacctattattacttttctcccaactttgattattctccttttatcattagggtctattttcggagccgggtctccattaggcatcatccccgatacattagtatcaatgctttttgcgacattcgcctgattcctatccagttcctctttgcttttcctttctctatttcgctgatgctcatattccggactaatagcattcttcgcttgatagtataaaagagtaccaaaagcataagacatcctaggagtatctgttattatttgtccaacttctgcaaactttcctgatgcatgtctcattatttgttgatccgaaggcaaattataactttgaggatacgttatcggagaatagaatggaagaggtgcataaggcattggaacaggtattacttgctttccatctgggtcaatatatttaattgtattgttctgacaataaacatacacgctccaactataatccttatccgccatcggatccaccacatgccatctacccaacgctgcatcatacattctcgctccataatcataccaatccagtccgccttttctatccagttctttcccattgtacttgtaaggctgaacagaggaagttgaagcaaagataccgccaaacggataataatgattcacttcttccactgctccatcctgcgataccactacccgattgttaccctgatgatcctgtaagtaataatgatacttattatcattcaaagatacgaatccggcatctgtcaataaagtcttgggagtcccattttcatagatcacattaccgcaataatcggtagtagttgtatttcctgcgatactatgtacaacacggtgttttgtgcccgctgcatcataaaggtaagaaatagagctgccatcttcgaactctatacggtccggtaaatttaggtaattatattgaatattgattatctttttattcaaatctttcgataaattaccattggcgtcataaaagtactctgtattctgttttactccgtctttaaaattaaaattatcaccaaaagcggaacccgaaacagaatcatcaacccttttcagttggttgccactcaaggtgacggacagattatctactaatccgtaaccattggcagaagtttgtccatatcgtttcaatcccaagatattaccatttttgtcgtaacccgttatttgctcattgaagcggttgacattcagagagagatcttcaccctcaccgtaagtagcattttttagccgggataacagatcgtattcaaaacgataaccacgaatatccaggttcgcactggttttccaggtcatactactgatatttccgttataacaaggtgtgccgatgccatctgtataatatagtttctgggaaaataacggactttcgatagaagtcagccagccacgtaagttataacggttggttgaggttagtgaatggttcccgttcactcttttgacattggcgatgtgtcccaactcatcataattatacctaagagtatcagataccaagtcattcaccaaacgagcttctgtcaacagacgtccggcatggtcataagttttagtttggacaagtgagatattttctactttgtcattggatgctgtaatgtggtcgcagaaatcatacgccatgttctgaacgtgcaccttaccatttatatccgtgctacgtacttgcaccggacgttgaaaataatcataataggtactggtacaaagcatttgatctgtaccgataacccgtgtcatcactccagtctgcaaattcttgcagttcagttgttcagagtcgtctccaaatcgatgtccataatcattgctatctatataatccattgctgcaatgaagtaagaattagcctttttatattgataggtatcataatatgccaccttttggatattcaggctgtccatttttaaataactgctaaaaagataaccataatggttgtttggcttatccggagcaaactcaacagatgcagagctgctgtatgacatcatacctttataaatgccagtcactacttctcttctcaacttatcataaaaagtacatttccattcgttccttttgcgcatctccccatctcgacttctcaataattttccgtccttgtcgaaatacatgtctatccattccgcaccaggaagtttcttacctctataatggttgagctcatcatagcgatattgataggcataaagatctaatgcatctttctgcccaagcgtctgtaaactgctgactgccatcggtggaagaacaaaagctagattcccgaaatcatcatatacttgataagtatccagcgtatctgcaccactgatggtacgtgatacaatggtttgttccaatttattggtataggtaagtgtaggaagccctgcttcatcttttttttcttccactaccaattctccggttgcataaaatcctttttgcgacagaacgggattatctttttctccgttcacctcaaatagtcgaatctgtgatgttcctgaatttgtctgataagaaaccttttcactatgccccgtagtatgccagtcttttccaggattgtatttctctgtcaatcggttcaggggtgaaccgtcatacagagatttttcacaagcatactcatcattatacaattcaagaatatgctttctgaaatcggatgatgaaacatagtcgcccgaaccgggacaaacagccggaagccatgaacaactatcacgatacatcctatcgtactcctttctgttcaccaggctgtttaatgcaggagttataccgtattgtattgtctgttctgtcctgccgaatggatcaagataatctatttcacgagtggcgctcaacggtccctgcaaatcggaagcaaaaggagtgttaattatacttttctctgttgacacataattctttatatccgacaattgttgaacagactttttccctttcacttttataacaatagtaccatttcctccttctgttacaaaaaagtaagtacccggagataacccaaatacatcaagacttgtcaagtaatcatctttctcctctttcctaactagatgacgggtagaatcgtataaggtgatattgttcagatactcttctgatatgatggatatatccatcgtatcttttattgtgaaacgatgatatacacaaggccttgaagaagatcccgaaggaacaaacatatatggataatagaaagtgctataatccaggctatccgaaaaacttccgacctccaaagggtgttcccaatcaattcccgcattatcaacaatacctgttacacgtagtttaggtttccgatatgcagaatccggatagtaagcatgaatataaaaatcacctacaccacatctgaaatctttaatttgcggtaaagagttctcatttagtggatattcattgctactaaccaacgatcgataaagagtttccatttttagaatgggatttacacctatagtgtccaaaggaactacacttatcatattgatactatccaaactaaatttacaatatacatctccaccgctaaaagttccgagtcttatttcttgagaaaaattcctcgtaaaatgtcctatatcaacagatgtatattcatttactcccaccggagataaataaatgttggtttcaagcctcttggtaggttttttcgtatcctctgacgctacactataaagctcatattcgccaggttctaagacttcatacaatacaggagagtgaagatgtacttgtgtaaggtcttcgtcaaaagtaaaattaaatttatcctgattactaagtacctcctttactttgtgactatcactactataacttctctttctgaatctaccggtagagtttaatggtctataattgagacggaacgaggtataatccgtgtcagtccccatcatattagccataaataaagtggacctgtcctgtatggtaaaagtatagataacgtaattatgaagctcaccttcgtagaatatataacgaggaacatcactaaaatgagcgatttccggctctttataaatatctgcaaaatgcatccttttatcaaccaactgtggattattacgaccatccaccgccattaatgcgcaaaacaagaataagaaaaatattaaatgccttttcataattatcttttatttagaataatgatatctgttatattccatcaattgaatgtctcccttttctcctcttctaaaccttttcttcagacgcccttgaaggtcatactggaaaaaagaagtttttccatcaggttgagaagtatatttcataccaatctgctgcttataatcatagattgttatctgggcatgcggcagaagtctgcgtagttgttctatattcttaatattaggttcactctcttctgaaagactttccggttttctttttaaggcagactttacttcattataagtacttccttttatttcagctatcggatatttaccgtaatatgaccatagataaattgtaatatcattatgaaagtttcttagcgtaataagatttccatatttatcatagttgtcataagcttcaataaaagacgtcaagctatcggttaaatagcttgtcagatccatattttcaggtaatctttttaggaggctactgccccgcaaagttcttttttgaatacctgcactactcgttggctcataatagagatatataaaatctattattttccgtttttcatcttgtgacttcttcaagtactttataatggcgaccggttcctctattctatttaaccggattaaattgtcataatatatagttgatgggagattagatgattctcccggatgcacatactttaaatacacatgatccccattactattgacagtttctttttgtgtgacaaatccatttgcattatattcataattatgaagaattgacactccgttttcatctgtcagtttttcctgaatcaacaaacaagggacagtaaatattttactcgccagaatagctccagtaccagtatctatcgaaacttcataatcggcagttttattttctacgttataatgatactcttcctctgctactttatgatagcgattgttataggtcgtcttaaacagtagttttcccctgaaggctgccagatcgttaggagcatagttcagagccttatctaatacctgataaaagccgaaacttcttctgttcaaattgtccggtgttctagtgacagcttgcccaaactccgcattatcagggatatctgccaatgaagagaaatgataacgacaaaaacttccgtcgtcaaaagtctcagtgacataactataacctatcggatattcggatatattattgaatcgccccatacagttactgctgattgagtaaacattcagatttttggtttccatataatcataatagttataactgtataccatatcttctataggcatacgatagcgtggcagttcatgggttcttccactttccattcctgtcgtagggtcaaggtagttgaacgaacgttgcctgtctttttttgtaacagggtcatgcaatgtcagatgtttcacacgtaccccacccaacggagcatcataagttgccatattggtatcccaagcaaaagaatcagttcttttggtcaggtaatgccggtaacggttgtattcataatcaatcttttcttcccctttggtgggataagtgatcgtattcagcattgtacagctagaaacacctgtgttgacagcctttctttgttcaaaattcccatcatagaaaaacgtattggcattgtctattttttcatagccaccattccagaagccccaatgatcgacgtttgtagtcaacggatccggtaaatcattactcatattatagtcaaaagagtaaatagcagggccctcactttgatcatgcaaggtcacatttttcagaaagaagtagcgccctgatgtttcataatcaaatttgcatgattttataacttggggggcttttgtcattgttatacttgagagatagattaaatcattcccatccgaatcaccgaaaaaattaacagggaaagtctcggtaataaaattcacaagcacacttccagtgctaattgtcttcaaaataggggtatacactttatcttccatcaagaaatgatctgtatctttatcgtttatacctattatttctgctggtttagtatatccattcttatcaggtttataatttatccatcttgttccggttacattagaattcataaataagtgatacttatttttttgcagacaactttggtatgaaaaggatataccattattttttgtctcatcctggatagaacttaggtaccaggaagtaatctgtaccggtctgcttcttaatctaccgggattattgggtatgctgtattctaaacatgagacgtctcctccaaaatagtaaagatagccatccggtgtcgtgatcttgatgacagagcgtttaggagcatttgtggtactataatcctgaacagacatttcgcttaaatctatcctatatccgcctcctgatatacattttgcatttccattattgtcgataataaagcgtcctttatgccgcccgaaattaaaatcgaagatatctggagccatatcatattcagtttccggataaggacggtttttagtagcatggggaatattcagtttgaatagatccgctttactgtactgcttaaactttccgtcgcgaatagcagccaacagaccgcttttctgctcctggcgaacatcatcaggatttcccactacatttcttgtaatagtgccacccacgttcagtatccagttattacctactaccgaaggacgccgccccggtttgaaaccatcggaaatatacttgatagacatgttcaactcaaaagccgtatctttgtaatcgaacaatgggatatccagatcaagcaacccgttgtagtagttcacactagtgttgccatattgtacgaattctgctgtttgcggtgtagaaaacccgagattctgcggtgaaaaatagtacccttgaaaatcggtcggaataaatccggaactgttttgcgcatatatatgtgtgcctgtgcctaacagcaggagcaaacacaacatttgttctataaaattcttctttctcattttttatatgatttatcttatgagtaataaaaaaatagagagggtgaaatagaaaacttatacaccctctcttcaaatgaactaaccctctgtatctttacagattcatcgcattaccgcccaatacgcccgctactgctgacgccactgcgatgactactttcagaatcacatcccaaagggattttttaactgccataaccttacacacctcctttccatactctattaataattgactgatttcagtaaccaattacgtttaatgattagttactttcaataccctgttacttcctgaaaaccttcctacctcattttctcgttatcctattgagaactaagcttttactcatcaggagttcaaaactccgctttcacctcaaaacacggacacgccttgatccattcttccggttcaatctccccgtttccgttgcggtcgggacttaaatcccggtgaccgcacacccggctaccggggaaagtctcaaataattgatgtaccagtaagcggagtgccgcccgttgttccggtgtccgcgtgtctgccggacaaccgtggccatccaaaccgccttcgtagcagataccgacactgttcgaattgaatcctttcacgtgcgcaccgatacgttcaatcggtcgggtgaggtgcactgttccatccttgcggatgtagtagtgataacctgttccgttaaatccacgccgacggtgttgcatctccaagtcatccggggtgagagaacggtcggcacgggtggcggaacagtggatcacgatcaaatcaatctttctcatcatagtgccactatttttcttatcagttgtaaacattatctgcactctacgaattaagctgccggatccggagcttcaccactacctccaccggagtctccgccaccttcatcaccgggatcttcaccatcggttttctttttcttgggcgcgtcgagatccaggaactcgattttctcaccggcacgggtagacgtcagattaggacggacactgctcgaaggacggaaattaatgttcaccgtcttgatgttcttcatcgtacactcatctttcgtgtccactccccgcgtggtagcggaaaggctgaatacaccaaaatcatggatattgacggatttaccgtcgaacagcgccgtacgcatcgcttctacgagattagtcagcacactctgaatgtcacccagcgacagggaacttttctctttcatcgtgtaagcaagtttatccaggtctacactctgtccctgcgtcacaagttgcggatgatacttcaccaccccatcaacctttctcgggtctttacgacccattcttttaaatggtattgccatgataaattaaaaattgagaattaataattgaaaaataaatattacagattgcggttgccgcaatcaatatcggaagagaggaacgagctctgtttctttttctttcgatacctcaaaggtagtgtattataaggggatgaaatgacgtactttgtcttactttgacctagtttgtcttactttcattcagaatgtatttacttttattcagagtgattttattttacttatatacttggacaagcgggagattttccgtatatttggaatacgataaaattaattttccgaagatatgaaagcagaaaaagaagagatagcagaggagccgtttgtcatacgtccgtatttgaaatcggagctggcacatttatataatccgtatgtaccgttggtgtatgccatgcgaaaaatgagggagtggatcagaaataacaaggaattatatgacgcaatgtatagtggcggcgaaggaaaaaacgaccacgcttatagtgcaaggcaggtgcggctcatcgtgaggtatcttgatgagccatgaatctctttagggcaagtgctgattagctataacgaaaataaaattagctataatgaaatcgagattagctataatgaaatcgagattagctataatgaaatcaagattagctataatgaaaacaaaagcggttatgggagtattctgtccgatatctgttttataatgccagccctgcaaccgtgccctgtcgatattatgatgggacgcggtgtaatacatggtatcttgaggacaaacaggctgtgtgttttcttattgaatgctgttagttttcttatttaataatgtacacgtgcgcaggcgcgagagaatattctttttatatagaaaaagcgtgtaattgaggtggaggggttccacctcaattacacgctttttccatcaaataaaatatataaagagaataaaaagtataagtaaacgataggaacaaaataaaatgtacctttgcgtctttttagaccaacattttttaacactaatcaaataacacttaaaatcatgagaaaaaagacattttttccgaaggcttcgtttaccagaacaaacaggctgtaacactcgaaaagggagaatttccccaagtatccccgtttatcacgcaaatgcttggcactgtcaacaatttgtataccaacagaatagaggtaagtccaggcgaccgcaagaagtttctcctcccctttgtccatctctgttatgaccatgactctgtttttaacattaaaagccccaaatactttgcagagttgttgtttatggctgttgatttcaagaaatcggatgattcggacgaatcattaagcgtggaagagattgattatgagatacaaagaatgaaaagaacgcttcttgaggattaacacgaaagaaccgactgttaaaaaactgctttttgagtaccaaaagcagtttttttattctacatgaaaagccgtcctttgcagtgtgttaatattgacacgacttacattcatatcaataattaaaatggaaaatatctcaataacgacatacaggggattatcactcgtatcaggaagtatcagtatccggcaaatgttcgaatttatccggggagatgtctatcgcgacagaatccggagactccgggaagcaatggatgcaggagaaacggtgaaagcagaccacatgaagaagcaactgccctactgcaccatcacagctacttacgccaaggaaaggctggcttacagtctggacaagtatcaggacatcatcacgctcgactgtgacgatatgccggcagaaaagatcccggaattccgccaactagtgaacgattgccccgacacgctaggcagcttcgtcagcccccggatgcacgggctgaagatcttcgtctatcttaccggcaatgaagcggaagccttacgcaccgaactgaacgcattgggaaccgtagacttcctcaccctcgaacgctaccaccaccgcatatacgccctggcaagcagccaatatgaaaagctgctcaataccaaagtagacaccagcggaagcgacccgggacgcggattcttcgtgtcgcacgatccggacgctttcctctctaccgaacgactggaaaacgtaaaaccgctgaccgtaaaagtgacactgcccactgaagaagaatgtaaaaacaagaagcgcaagaatccgggaaaacgctccccgctcctccccgtgcaggagaatgcgtcgcccatcgacctgcaagtgcaactcgacttccgcaaggcgctggagtacaccaaacgcaaagaacgtctcgagataggcaaccgggacaatttcttctattgtctcggcaatcagtgttaccaccgccatatcacggaagaggaagccgtcagtctggcacacagtcatttcggcgacctacccgacttcgacctcgaactgcccttgcacaatgcttaccaatacacctcaaagaccgatcaggcagaagaagaaagccaacaaccgagaatatgccaggtcatcaaatttatggacgaacactacgaaatcaggagaaacgtggtgaaagagcaaatcgagttccggaaaataatacctgatctccctaaaacagagcagccgcctttcagtacattgcgcacaaaggatgtcaacacattctatatcaacgcacagatgaagaagatatacagttcgcaagctaatttgaaagcactggtagactcggactatgcaaagccgttcaacccgtttattcattatttcacctcactccagacatgggacgggaaaacagaccacatcggccaactgacaaaaacagtgaaagcggcagaccaggctttttttgaagacagcttccgccgctggctggtgggaatggtggcatgtgccatcgacgacgaagcgcaaaaccaccagttgatgctgctccacggcgcacagggaaaaggcaagagtacttttgtccgccatctcctcccaccggagctgaaggattattatcgcaacggcatgattagtcccgacaacaaagaccatctcctgcaaatgtcgtcctgcctgctcatcaatctggatgagtttgatacactctctcccacacgcatgcaggagttgaaaagtctcatcacgcaagatgtgatgaacgaacggaaggtttacgacatccaaaattatacgttcatccgccgcgcatcattcatcgccagcaccaacaatccgcactgtctgccggacatcggcgagaacaggcgcatcctgtttaatacgttgctggaaatagattatcacacgcctgtcaaccatcaggggatatatgcacaagcatacgcactctaccggcaggggtttcaatattggtatgagaaccaggagattacgtttctcaacaaccgcaatgaggcgttccgccaaaaagatccgttggaggagaatcttttcttctatttccgggcagccagaccaaacgatatacaagcaaaatggtatcctgcctcccagctgctgtcgatattgagcatgaacgggcgcacacaggccaacgcacagatgaaacaaatgctggtcacggtattggaaaacaaccatttccactcacggaagacctccaacaatatcacggaatattgggtggtggagtattcggccgaagagcgcaaagaaaattcaatacgcccgcagctcccggtgcagacggggttggagttgtagttttcccgcgaaatggcagttttcccacggatagtcgtttttccacaaaatagcttttttcctccaaatagtcgtttttgcacgaaataacagataaacggataaattagtggcattaaacgtgtcacattcatccgttttccgtatatttgctcgatatgaatgatgaataaagaaaagaatcgcaatatgatgaagcaaataccatacggattgacggatttcggtcgcatccaaaaagaaaactattattatgtggataagacgatgtttatcgaaaagatagaaatgcaaccgtcttatctgttcctgatccgtccccggcgcttcgggaaaagtctgacgctggcaatgctggaggcttattatgacgttcggtatgccgaccagttcgacgaattgttcggcaatctgtatatcgggcagcatcctacgccgatacataaccagtttctcatcatgagattcaatttctcggaggtgagctcgaatatcaatgaggtggaggaatctttccggttgcattgttgcgggaaactaagacattttctgcaaaagtacgaacatattttgggaaaggaaatctggaacgtgctgaacgaagaaacgctcgaagaaccgggagcactgctatccgccatcaattcgtatgccaccctcaagggagacatcaaaatctatctcctgattgatgaatacgataatttcacgaataccattctttctacttacggcacggacttatatcgaaaagcgacgcatggcgaagggtatatccgcaggtttttcaatgtaatcaaagccgccacgacgggaatgggttctgccgtcaaccgtttgttcatcacaggagtaagcccggtgacgatggacgacgtgacaagcggattcaacatcggaacgaatatcaccaccgacccttggtttaacgaccttgtaggtttcagcgagaaggaattgcgcgagatgctgacgtattataaggaacaaggcgctctcccgatgtcggtagacgatgcagtgacaatgatgaagcctaactatgacaattattgcttcagtgaaaataaattagcagattgtatgttcaactcggacatggtgctctactgcatgaagtcattgatattgcacggagtgaaacctaaagagattgtagatcccaatatccgtacggactttaacaagcttgcctaccttgtccgtctcgaccatggactgggcgaaaacttctccgtcatcaaggagattgcggagcaaggcgagatagtgactgaaatagtcacccatttctccgcattggaaatgacggacgtgggcaacttcaaatctctgctgttctatttcggactgctttctatcaaaggggtggatatgatggggcgtcccatcctgcacattcccaatctggtggttcgcgaacagctattcaatttcctgattcagggatatgcccgtcatgacatcttcaagctcgacgtgaaccgcttgcgcactctgtttgagaatatgtccttcaaaggagactggaaaccgttgttcgaatttctagcagaggccattcgggagcagagccggataagggagtacatagaaggagaagctcatatcaaaggattcctcctcgcctatctaagtatgttccgctattatcaactatatccggaatatgagatgaataagggttttgccgatttcttctttaagcccagtccggcggcacccgtatctccaccgtacacgtatctattggaggtgaagtatgcgaaagcaggagcgtcggagaaagagatacgcgcacttgccaatgatgcacgggaacagttgattcgctatagcaaggatgaatgtgtggcagaagctcgtgagaaagggggattgaaactggcaacgatcgtatggcgcagttgggaattggtgctgatggaagaggtatcataaagtacttgtcacatcacaaacaccgatttaggtatgcactcacctccacatctgatattgggctaaataaataatcccatcagaacaggtgaatggaatcctatctataaaaatcaggcgcggattacacgaattgcacgatttctttaaaatcagaaacgtgttatccgtgtaattcgcgcctaagttttatacgatggctacgacatccaagacggggaattacttatccccgtacatcttcgctctcaattccttgatgtgatcggacgtgatatattcgtcatactccatcatcttgtcgatgataccgttcggtgtcagttcgatgatgcggttggcaaccgtctggataaactcgtggtcatgagaagagaaaaggatgtttcccctgtatgtcttcaggttgttgttgaatgcctggatagattccaaatccaagtggttggtcggagtgtccagaatcagacagtttgcattgcggagctgcatacgggcaatcatacaacgcatcttctcacctccggagagtacgcttactttcttcaacacctcttcgccggagaaaagcatacggccgaggaaacctttcatatacacttcgtttccttcgccaaactggctcaaccagtccaccaggttgaggtcggtattgaagaaatcggtattatccagcggcaggtaagcagtggtgatagttaccccccagttgaaggtaccggcatccggcttcatgtttccgttgatgatttcgaagaacgcagtcatcgcacgcgggttgcgcgacaggaataccactttgtcacctttctctacgttgaaattgacgtcgttgaaaagcactacgccttcttccgtcttcttgctcaatccggaaacttccagaatctggttgcccggctcgcgttcgggagtgaagataatgcccggatacttacgtgaagaaggtttgatttcttctacgttcagtttctccaacatcttcttacggctcgtggtctgcttgctcttcgctacgttggcactgaaacggcggataaattcttccaactctttcttcttctcttcagccttcgccttctggttctgctgctgacggagagccaactggctggattcgtaccagaaactatagttaccggcaaacatattgatttttccgtagtcgatgtctacggtgtgcgtacatacagaatcgaggaagtgacggtcgtggctcactaccaatacggtatgctcgaagttggaaagatactcttccaaccaggtcactgtctccatatccaagtcattggtaggctcatcgagcaagagattgtccggatttccgtacaatgcctgcgccagcatgacacgcactttttccttaccgctcaactcacccatcaatacataatgcttatcttctttcacgcccagtccgctcaacagcatggctgcgtcgctttccgcattccatccgtccaactcggcaaatttctcttccaactcggatactttcagtccgtcttcatctgtaaaatcttctttcgcatacaattcttcgcgttgcttcatgatgtcccacaacacagtatgccccatcatcacagtatccataacggtataagagtcccacttaaagtggtcctggctcaacaccgaaaggcgttcgcccggtccgagcgcaatggtacccgttgtcgggtccaaatctccgtaaatcgtacgaaggaaggtagattttcccgcaccgttagcaccaataattccataacaattaccactcgtaaacttcaagtttacgtcattaaacaacactcttttaccaaactgtaccgaaacgttcgaaactgtaatcatcttctttatttactattttactagttactattttactattttgctagctactattttactatttcgttagttactattttagtattaactattttagcgtgcaaagttagacatttaaaatgaattatgagctatctgatatgtgccaatctgacataaaagtgttacctttgctgcgttttttggcaaaacagccaacttggcaaagtttttgcagacaaaatcaatgacatccggtcagcccggtatgtttattggcgttattttaccaagttaagataacgtgtgtgttaaatagtaaatagtaactagtaaaatagtaaataccaagatggatccgaaagaaaaaaaagtgaaggaagaagaactgaacgttgaggaaactcaaaaccatgcggaagaacaaccgcaaaacgaacaagcggaggacgccactcccctgactcatgaagaagagttggaaaaagaactggaaaaggcccaagaggagattgaagagcagaaggataaatacctgcgcttgtctgccgaatttgacaactaccggaaacgcaccatgaaggaaaaggccgaactgattctgaacggtggcgaaaagagccttagcagtattcttccggtagtggacgacttcgaacgtgccatcaaaacaatggaaacggcaacagatgtcaatgccgtaaaagaaggagtagaactgatttacaataaatttatggctgtcctggcacaaaacggtgtgaaagtcatcgaaacaaaagaccaaccactggacactgattaccatgaagccatcgcggtaatccccgcaccgtcggaagcacagaaaggtaagattctggactgtgtgcaaacgggatatacactgaacgacaaagtgctccgccacgctaaagtggtagtaggagaatgaaaagaattatgatttatgatttatgatttatggctgcgctatcctactgcagagtaaatcataaatcataaatcaaaaatcataaatcaataaatgggcatggcagaaaaaagagactattacgaaatattggaggtgacgaagacagccacagtagaagaaataaagaaagcataccgtaagaaagcaattcagtatcaccccgacaagaatccgggcgacaaggaggctgaagagaaatttaaggaggcggccgaggcatacgacgtgttgagcaatccggagaagcgttcgcgttacgatcagttcggtcatgcgggagtgagcggtgcggcaggcaatggcggtccgttcggtggtttcggtggcgagggaatgtcgatggatgacatcttctctatgtttggcgacatctttggtggccgcggcggcggtttcgggggaggcttcggaggattcagcggatttggcggcggtggcggttcacagcaacgccggtatcgcggcagtgacctccgtgtgaaagtgaagctgacgttgaaggaaatctctaccggagtagaaaagaaatttaaactcaaaaaatatgtgccgtgcgaccagtgtcatggcacgggtgccgagggtgacggcggatcggagacttgtcctacttgtaagggtagcggctcggtgatccgtaaccagcagaccattctgggcacgatgcagactcgcgtcacttgttctacgtgtggcggcgagggaaagattatcaagaataaatgtaagaagtgtggtggcgacggaatcgtttacggtgaggaagtggtaaccgtaaaaatccctgccggagtggcagaaggtatgcagctctctatgggcggcaaaggaaatgccggcaagcacaacggtgtggcaggcgacttattgatcctcgttgaggaagaaccgcatcaggacttgattcgcgacgaaaatgatttgatttataatctgttgcttagtttcccgacggctgcactgggcggtgctgtggaaattccgacaatcgacggcaaagtgaaagtgaagattgattcgggtactcaaccgggtaaagtgcttcgcttgcgtggcaaggggttgccgaatgtaaacgggtacggtacgggagatttgctggtcaatatcagtatctatgtgccggaagctctcaacaaggaggaaaagaacacgctcgaaaagatggaagcttcagacaatttcaaacctaacacgtcggtaaaagagaagattttcaagaaattcaagagtttcttcgattagtctttttgctatcatattattatatataaggtataagtgggctgcaatctttttgtggcccactttttttatgatattctctaaatagactccctctcgcacaatcttttcatatagtttacctaaataaggcgcgatatagggctatcctaaaaaaaatggcatatatttgtataacaaacaaatagatcggcataaaataattatcaacactttaaaattcaaattataaaaaacgaatttatcaaagaaacattatttagtcgctccataaaaaaacaataactgtttaactaaactatatatttaaagaatggcagaaccttttaaaaacatgtttaacgagcaatttttcgatctgtttacgaaagatttgaaacttgttatcgacgattttgatgctcgcgagtttgtatctcaagtgatggacgatgaatgggaaggcagggaacttaaacaacgctgcatgcacatcacaacggtgctaagaaagtttttaccggcagattacaaagaggcgatcgctaagatacttgaattgttggatcatataaaaaagacacggcctgatttctcggtgatagacgacacgaagtttggtttgactttagagtatggggggattctggataattatgtcgaacaatatgggttggacgattatgaaacctctgtcagagcgatagagaaaatcacacagttcacaagttgcgagtttgtgactcattcttttattatcaaatatccggatcagatgatgaaacagatgttggtttggtcgaaacacgaacattggggagtcaggcggcttgcgtcagaaggctgtcgtccgcgtcttccctgggcgatggcgttgccgaacctgaaagagaatcctgcgcctatcattcctattctggaaaatctaaaaaatgatccggcaagatttgtgcggttgagcgttgccaataatttgaatgatatcgcgaaagataatcccgaaatcgtcattgatttagtgaagaaatggaagggagaatcgaaagaggtggattggattattaaacacggttgccggacgctcttaaaacaaggcaatccggaggtgatggagttgttcggcttcaactctactatcagcaatatctgtgtggaggatttccaaatttcaagcccggaagtgaaagtcggggattcgttggaggttagttttaaactgttgaacaagaacgatcaaacgaccaagatacgactcgaatatggaatctattaccaaaaagcgaatggaacgttgacgaaaaaagtgcataaaatcagcgagaaagaatatgccgggaactcaaccacgcgaatcacccgaaaacattctttccgggtggttacaacgaggaagctccatctcggacttcatcaaattgctatgattatcaacgggaatgaatttgaaaaatatagttttgagttgattgaataataactgctgttaataccccggattctgcttcaacttcgtattcatcacccgtattttctccggtatagggaacacggtagtatatccgtttccctcatccggcaattgcggacggctactgtaagctcttgtaaacttcccgaagcgaaccaagtcttgacgtctccaaccttcccaagccagttccagttgacgttcggcaaggatattctctaaagtggcaggacgggaggaggcattgacgcggctacggacttcattcagttcttcatctccactggctccattgcgcactttcgcttcactcttcatcaacagagcatccgcgtagcggaacagtacaatgtcattctccatcaacttaccgtcttttgtggcagtggggtcgacttcgtactttttcatgcgggctcctgctgtttgttcatacggggtatctgtaatatccagagctactttccaaggcagatactccaatacggtgccatcatccagcttgatgatgtttcctttcaggtcgcgcaccactcccgcaaaatagcaaatatcaaagcggggatcttgttcggctgtttcataaccgaaggtttcgagggcttcaatggttgcgctggggccgttctcaccacttaggccgtacgccttggcatgattgtaatggcgggagcggaatagatattgcatttgattggtgtacaaggttttattcatcggaatggtaaaaatattctctatcgatggttcgttgaatatggagaaattggtttcgtattccggttccagtttgtagcccagcgcctttagctggtcacagtagtagatgactgtttcccacgcattgagttcgttgccgttcactgtaaactttatgttttttccgtccggacgttgtccgtctgtccaatcattgtccgtatagacttcggaattcagagccagtttagccaataggaaagtggctaccggacgggtgatacgaccataataaggaccggactggttgctgtgcgcatcgctcaacagaggagccgcttcctgcaattccttgaatacaaactcaaaaaccgttttccgttcactctggacaacctctttcattgccactgaagaggattgaaccaacgggatgcgtccgaacaaatccatcagataataataatacatggctcgcatggcctgcacttccgcccggtatgccggaagtgcagcatcggaatgggtttcggcaaacttgtctatccgttcgagcgatttgttgcttagcatgacgactttgtaaagatattcccatgtagcttgaatagcgtcattctctactccccaatcgtgcaggtaaagtccttgccaaaagccgccatcgtaccagtcgcctccacgggtggggatgatagcttcgtcggaagtgaaagtgttcaggtcgtagactcccctacccgttccctgcaatccctgactgtcgctataaccgcctacgtaggtataaagcgaagctaccgcattgagatatacttccgagatcgtattgtagacatcctcttccggtagtttgtccttcggattttcttgtaagaacttatcacaggaaaataaggtcagactcgtcaccagaagaaataataatattcttgaagggtagattatttgctttgagatctgcaaaaactgatttctatttttcatatatcgtttcatcctctcctcctccattaaaagttaatactcaatcctaaggtgtacgtccgtgccaacggatacccccgtttatcgtccacgcccaacgtcgagttcaccgtggaactgttaatcatgggcgaaagtcccgaataaccggagatggttgccaggttgttgacagtaaatgccaagcgcagggaacggacatatttctttagcttctgcaccttttcaatcggcacgttccagcccagcgtcacatagtcgaagttgacgtaatctcccttttccagccaatagtcggtggcagtctgatccttgatgttctgttgcggagctttcttcattacgttgtagtcggggaatatattcatgttcatataggtcagggaagttccgttgtagattttatgtccgaaggctccgttgatctgcaaagacaggtcgaaacgcttgtaacggaaactgatgttagatcccagaatcgttttgggtacggcttgtcctgccacgtaacggtcttcaccatcttccagactgacgcctccgccattcaggtcggcgatgccataggtatatccaccgtttccgtcggactccagtccggtgctgtgaggaagatagaacacgcccaacggttgccccaccatctgataaacgatgtggttgtagccgccgtggaagccggctccatcaaggctggcaagacttttatattcggaagcggaaagcatttcgccgttatacataccgctcaatgaaagcagtttgttgcgctggaaggtgatgttggcattgatattcagttccatgtccttcgttttcaaaggggtgacaccgatggcgatttccgtaccccagttgcgcatggagccgatattggcaagcaaggtgttataggtgaaagggggcacgcttacgttgtaaaggtaaagcatatccgtggtgcgggagttgtaatagttggcggaaagcaacaggcggttgccgaataaagcgatgtcgaaaccggtattaaaggtatgtttcacttcccatttcaggtcgggattcgtattccgaagatctcctaaagatacgatggcggagtttccgacggggacgacaccgttcggcttgacgagattcagcgttgtgtatgagtcaatcccgctctggttacctgccagaccgtaaccgatacggaatttcagattgtctatcacggggaattgcttcataaattcttcttcactaatcacccatgccgcggacgcagaggggaaaaagccccatttatggttggctccgaatttggaggaagcatctgtacgggcgttcaacgtcagtacgtagcggtcggcgtatgtataattgaagcgtcccatgaaagatgccaggcgcggttgctcgtagtaggaattagtaccttcccacaaacggagcgctcctgcctgaaggttattatacccgaacttatcggtgctgaaattgctgactgtggtataatagccggtataagtctctttctgaagttcggcaagtgcgagtacgtcaaagaaatgctttttccagtttttcttataggtcagcatcatgtttcccaataaggattcgcgctttttggttcctttgtatgcctgaccgttcgcccagacggaagtggggaggtattgcgaattttctacgatattgtaagtataagctccgaacaggcttagtttcagtccttctatcaggttgaaagtgagacgggcgtgcgtactgatgtgcgaagtggcatcatcgtcctgcacttccatccatgccaatggattggtgatttggctggcggttgttattccgtcccacgaattggtgacggggtctttatgattgggataggtaggattgaacgtagctgccgaatagaaggttttctgataatctaccaggttatgattcttctgaatggagccgaacattcccagttcgcagttcaggaagccgtcgaacattttctgattcatgttcatatttgaagtgaaattcttcatgtcttcattcagaatcactccctgacgatccataaaaccgagggaaacacgataactggactcactggaaccgccataaaaggcgatatgatgattctgttgcagtcctgtctgctcaatctctttctggaaatcggtattgttccctttatccagaatggaaatgcctcgttccgatgctacacgacggaattcatcaccggacagcattttcaaattcttgtagacggtggaaatcccgaagctaccgttgtaagccacctgtgtcctgccgctcatcccttttttggtggtgacttctatcacaccggatgcacctcgcgagccgtactgtgcggtttcggaagcgtctttcagaatggtaaaactctcaatatccgtagggtaaatggaggtaagcatactcaagtcgccaaatactccgtcgacgataatcaaagggtcgttgccgctggtcagtgaggtagttccccgcaggcgcaccgcatccagagccgccggtccgttggagccccgttggatggtcaatcccggcacacgtccacggattgcttccaaagggttcgttatctggtctttgttcatctgtgtctccgtgattttctctacggaaccggacagggttttcaaacttccggtggcatatcctacggtaatcaatgaatctatgggcgcgacgggaatcttctgtgccaacgtgccctcgcacgggattaccaaaagaagaaggctgtagaaaatgagtctagcgtgttgtaccatattcttagtttttaaggtaataatacaaatataacaaaaaaagagggaatctggttgagtagattccctcttttatttaaatgatattgacaggttgaaatcagcaagtccggatgatacggattacacggttgctttaggccggaataatcctaaaaaaacgcatcatacgtattatccttatgcctgcaatatttatttcacaataatctcatccgtaaatatccagcctccgaattcacttccggcctgtgcctgatagcgtacgtatcttcctttggcttcgccctgccatgaaatatccgtaaagcggatgggtgtttctttgctcacttcaaagtgttgtttgcgcaactcggtgaaatgggttccgtcatcggaaatggaaatcaccacagtctccggcaggaatacttccgcgcctaccacctgcataaaggcggcagtgacagaatggatggaggtttctttttccatatcaatcgtcacatcgaggcggttgtccgagatgaatccttgccacgagccatcaccataggtccaatcgccacgtatgccgtccgtcagagcggtgtttccctgtgccggataatgggagctgtaaggtgaattataaatcacctttttacccaatgccagatggctgaccgattgaagcgactcgggacggctgccgatttcttttttcaaatcgaaaggatggtatccttttgcctgcaaatcggccactgccgacaatgcacgggtatggaaatccggccatgacttacgttccggagccgaccaggctgtttccgccaatgccaggattcgggggtaaatcatatactccacgtgttcgggagtgggaatgtattccacccataggttgccctgcacaccgtagaccaacttcgcctgttccgcagttaaagaagcgggaacgggattgtaagaatatactttcttcaacggcaggtatccaccgatggcttccggctgcgaatatggggcatcctgataactgtccagatagcagtaggcacccggcgtcatgatggcacgatggccggaggttacggcagcgatgccaccctcttctccacgccatgacatgacggttgcgttgggggcaatgcctccctgcagaatctcgtcccaccccagcagatgacgtccatgattgttcaggaacttctcaatgcggtgtatcaggtagctttgcagctcgtctacattggcaagatgctcgtccgtcattctcttctgacatttcgggcaggtcttccaagccgacttgccggcctcatcgccaccgatatgaatgtattcggaagggaaaagttccatgacttccgtcaacacattttccagaaacgtgaaggtttcttcattgccgacacagaaatcggagttcttgtaaggttcgcccgaacaggataactgcgggtaggctgccagcacttcttccgaatgggagggcatctcaatctcgggaatcaccgtgatataatgctgacgggcatattccaagatttcacgaatatcatcctgggtgtaataaccgccgtaagctccgggagcatcgaaacggacatatttacgtccgccgttccaccattgcttccaggtgggatctgtacgccaggccgcaaattcggtcagcaaagggtatttcttgatttctaaccgccagcctgccgcatcggtcagatgcaggtgcagacggttgattttgtaatacgccagtgcgtctatctgtttctttataaactctttggtagaaaagtggcgggacacgtccagcatcagtccacggtaagcaaaacggggagtgtcttctatctcgacagaggctatggaatagctgcctgcccccgaaggttgtgccaactgcaacagggtttgcagaccatagaataatccggctcccgaagtggcgcgtatcaggatttgttgcggagtgacggaaagggtatagctttccggcgatggcaactggtggttcttttcagttatcaacagagaaagtatattctgcgtatccttctttttccctttcttcaaatgaaccggcaatgcttgcaagcaattttccagaagctgcgcttctaaaccctgcaagtttatataaagttttgtgttctctgacagtaaaaaacagcccgtcccctgctccatttttaatgggacaggtatgacggactgtgctttgagggaatgtgcggttaagcacattcccaatacccataagaaaagacaaactttagcgtatctatttcttatattcattaatctatcgtgatttcgtctacaaacaaaaatgccggactatctttgccgccatgccatgccggcattttactttcagacaaggcaaccactttcacgtattgagttttcaccgggctgaatgacagtttatgttcatagataccattcttatcgctttctttcatagcaggatactcctcggaagcaactttggtaaagttcttgccatcgtccgaaacttctacggaaagtcctcgcgcgtcaaacacccagtcgcccttctccacgcaagtagaaatagcaacgctcgaaatctcggtaggctgctgaagatcgatagtcatgtccatatcgttcttgtagaacgcaatccaacgaccggttttgtaattgccatttcctttcaagccgtctactaatgtagattcgcctttgaacatgtattgcttgttgaccggctggttggctacaatcggcttcatgctggatttgctgaaattaaccttttcagaaaccacacggctatttccggtaggacggacagcaatggcagagaaagttacattttccttgattttcagcgggctttcataaagcggggaagcagcggtaggttccgtgccgtccaaggtgtaatggataggcgcattgtcaatggtagacaaagtgatgtccagtgtaccgtccgtcgggttcggcgtgtattcggcagttacattaaatacatgtttggcatagttgtatccttccgcatcgtaccatttaatcaggcgcggcagacgggacaggaagtcttcataattcttcttgtcgggagccgaccactggatttcggacaaggcagcccaacggggcaataccatatactgggcatgagagaaagtaggaatgtattcagtccagaggttagcctgcacgcctttgatatatttctgttcttccggagtgagggaagccggcatcggctcgtagctgtacactctttcaagaggcaggtaaccaccaataccgagaggttcgttctccgtatcttttgtctggtagtagtcgaaatacaggtaagtgttcggagtcatgataacatcgtgtttctgcttggctgcttcgataccacccttttcaccacgccatgacataacagtagcgttaggagcaagtccgccttcgaggatttcatcccaaccgatgatctgacgtccgtggtcgttgaggaatttttcgatatggttgattacgaagctctgcagacgttcttccttgctatgcttatcatccgatttcaagcccagcgccttgatacgtgcctgacatttcggacatttttcccaacgtactttcggacattcgtcaccacctacatgaatatattctgaagggaagatttcaatcaattcgctatatacatcttcgaggaatttcaagacttgatcgtttccggcacaaagcacatcttcagatactccccattgtctccatacttcgtacgggccaccggtacatcccaattcggggtaagcggcaagggcagcttgcatgtgtcccggaaggtcgatttcgggaataactgtgatataacgttcggcagcatacgctactatttctttcgcctgctcctgggtatagaagccaccgtaaggtttgccgtcgtattcaccggagttacgtccgatgactgtttctgttctcttggaaccgatttctgtcagcttcggatatttcttgatttccagacgccagccctggtcttcggtaatatgccagtgaaaacggttcatattgtgcaaagccatcatatcgatataagttttcacttcatctactgtaaagaaatgacggctggtatcgaagtgtgcaccacgatagccaaagcggggagcgtcattgatttctacggcaggcatggaaatgtctgcaccgacagccacaggcaatgatttgcgcagggactggatgccatagaatacgccggcctcagtaggaccagtaatcgtgattccgtcaccggttactttcaactgataggattccggattttcgtttgccgtgcccaatgtcagtacgattgcattcttaccttccgttccggcttcgatagcgaaatcttttccggtagcggttttcagatagtcggccaggaattgtgcgttgcgttgcatcttctcgtttccttccggataaaggattttcacaccgctcttcagaatgaagggatttccttgagctgttacaatttcttgtggcatggggatgatctggtagttggcgtcctgttgcgccgattggcaagaggcaaaaagtcctgctagtgccagacatccggttaactttaagagttgtttcataaactaaaaaattaagtgttaagttattaataaattaattataggtttcacgaatatgtttgattgtcaaaggcaactcctctcctttctttatttggggagaagtgatgacaactgtcttacgctctccgggaaggaggtcgaaaaagttgtcactgaaacgggctccctgcaaagggatttcaataaagacgtcttttgcaagagcgggagaaagcagggtcaattcgcacacgccgtctttctgttttatcttgcaggaaacggttgtcttgggcagaagcaggtctttcgtctttctaaagaagtagactgtttcggctaccgtatgcccggacttgtctttcaaggtcagttgcatgaagcaatggcgcaggtcatccgcaagcgggcgctttgcaggaaaaaacaaagtggtaagcgaagtgcgatatacacattgggaagtgttggccggaagagtcaaagaaggaaggacaaccgttcttccggctttctttcctgcaaaattcgtcagtctcatttccagcgtcagtttctcccgggtgtcaagatgatcggaaagcaggtaaacacacaggttgtcaccttccagcaaagggttgatatgaacgggggcaaatgcacgctttgcctgattatgcaaggctttccagttaccgtagtaatcaatacccgaccatgacactaccggccaactgtcattcaattgccaatataatgtacccatacaatagggacggttgcggcggtgcgcttccagaccgtgacgtatgccatgtccctgcaatactagtccgacatagacaaagtcttcaaatttttcgggaatgatatagtcacgttccatataggtgcgaatcagggcattgccgatgctgcttttctgatgggcattcatcacctccgattcgatttgataatcttcaggagccgcaaaggtggcaatagtcttcatctccgggaaggactggaaaccgaattcgctcatgaaacgaggaagatctgtatctagtgattcgaaagttttttgtccataccatactccccagttgtggctgtctcctatcccccatgattcggggcgtccccaattggctaaatacggggagctgtgtatataaaaacggtcggcatccagctcttttaccttggtaggaaggagttggtggaacagtttgtcatagccttggaacatttcctgatagatttccggcgtgaatttcttgtcgaatccccaatatttcaaggcttccagtatttcattattgccacaccacatcgccagggaagcatgattgcgaagacggcgaatgttgtagcaggcttctgcttctactcttttcaggaaggttggatcggacggatagggagtgcaggcaaacataaagtcctgccatatcagtattccgttttcatctgccaggtcatagaaacggtcgtcttcgtaggttccgcctccccacacacgaatgacattcatgttggcttctttgatgtccctaaataaggtttggtagcgttcggtagtgacgttagtcaatagggcatcctggggaatatagttggctcctttagcaaacatcggaacgccgtttacttcaaaatagaaggattctccgtcctgatctttttcattgacgaggcgaacggtacgcagtcctatccggtgggattgttgggctacgactttatcttctacgattatttgagcagagaaatcatacaaggcgggctttccccagccattcggcatccaacgtaccggcgacagcacttcggaaggaatagatatatgattgattccgggctgtagggtgattgcctggctaatgcctttttctgtgtttccttcgaaggaggtattgattctcacctctgcttgaagtgcttgagggaggatattatttatttccaattcgttggatagttttgccagttggtcggtcagcgagagttgctttacgtggtagtcgctgatagaggctgcgtcgtaataacggatggttaccggacgccagataccactagtcaccatgcggattccccagtcccagccataactgtaaggggctttacgggagaatacgcttacatgtttttcgtgatggtcgttgtctgccggatagttgaatccgttagagttatattgaggcattgtctgccggatgggtgaatgaaaatagatgtgaagaaggttttctccgagacggagttgtgacttgacgggtatcgtatagccgacgaacatgttatcggctttcaacaacagtgctccgttgaggtatacatcggcgtatgtatcaagaccttcaaagactaattgggcgtcgtcccgtttcagttgctcgggggtaactgtaaaagcagtccgatactcccagtcttcattttccacccactgaatcttctgttcattgataccgtaaaaaggatcgggaatttgtttatgatagataagatcctgatgaacggtgccgggaacctgtgccggtcgccatagctccgtgcctgcctgggaaaattcccaacctgcatttaaaaccacaacttcggaattgtcattgctctgcgcatatgccatactgcaacagcatagtagtccacatgctatttgagtcttttttccgatcaaatcaatcatcatagtgggggcattagatattaacggtttcaaagatattactttttcagcaaatttcacggataatttaacaaaatatgttgttttagcatgagctgtccagaaagccccaattaaatcggctaaaatttcagtttataattagttaaataaagagtagtattctgccctcaaatgtaagctgaaatggcgttttttattataatgatattctttttcattataactaaatcttgctacctataaatcgtaagcatagatttaaatcttcggactttcgggacagactctttattcctttattatatctgtcaattttatcgcttgaaaggttatatgtgcgacgctactctcatatagtataccaattgtctctttatcaatcattgtcagacaactatacccccatccttctgcctcgtcgagcattaattgatgttccggcaaccaggtaagtcctttgtccagacttgcttttattgttatatgattacgtcctttggtcgtattcgggttcgaaaacagcaggatatctttatttaatatgttatctttggcatctacatgaatcagactagccatgcataccggttcctgaagtgcttggcgggaagatgggtgttctgtccatgtttctcccaaatctttcgttatggaaacagcacgacttcctcctctattatcacgcatattcagcatcaatactcccggttctatttccaccacttgcgcttctgttgtattggttcgtgccatattgtgcattttccatgtgtttccccggtctttactatacatgattcctgcattcggaacacgggtagagtctataaattgcgttggaaataccaatgtgccatcactcatcgttattccacgtccgggaccttgaagcaggaagtaccaggaaggatctttcacctgctctgttatattgataggcttcgaccaggttttaccatcgtctgtgcttttagccaatactaactgtgccgtatgattcagatccattcccggatgggaattccaccaggcgcgttgattacccataccatgtgtccatgcggcaaccacccagacggtattcgtcttagtgtctactaaaatagaggggtcccctaccccattctgtgctttaggcagaccaccatactcgccaaatgaaagcggaagacgcatcttctcccaactctttcctccatcgatgctacggctcaaacccacgtcaacatattcctgtaaatcgacactactgttgtatcgaacatcatacacgcctaataaggttcctttattggtagtcaccaacccgggaatacggaaagaagcagaaccgtcatcaccggcatgacgaactccaactgccatccggtgaacgatattctttggagaaatagatttacaacataattctttcccatctacttttacggcacacaagtcagagagtatcttagtctgcaaagaggcatcttttttcatctgcaaactgatccaaaaataatttacacccggaaataaattgtaattaccttttaatacaactttttctgatgatcccacctctgcacatttgatcgaataggaaggaatagccgccaatgtcccatccggacggtggctggatatgtactctactggagcaaagcgatttttgtctttgtcctgcaacgcctctgttcctccataatagagtttgattgcctgaatatcagtcagattcgtacttttactaaaatctaaaatgatttcatcgagcttcttactttcttttgcatccaaacgaagatagaacagaacattgtcttgccgctctatcaaaaccgggatttgtgtttcatggataaatactgtgtctgaagcttttacgtcaaaagaatatcctaagaggataaggaaaagtaaataataaattcttctcataatgggggtattagttagtttaacgcgataaagataaaacttttctactataatattactatgcaaacagtaaactttgattttaccaagttctggtaggactagtcaatactttgaccaccattctggctcttgcgccgacaaggccgctcaaaggaccttttatgacacgaactttctcaccacgcgctagtggagtatcattcatacaaactgcttcttcggaataatcgagcatgaaacggaaacgcgccatctgctcgtcaggaataacggcaggagtgctttcaccacgcatcaccatataacggctaactgtggagaagcttaggacttccatacgctcttttggattgacatgaacaaaaaccatcatgggaagcaagactgtatcaaccatctttcgacggtcgctccattgatggatctgttgctgaacgggaacaaaagaatcaattcccatcttagacaaacgctcggataccttcttctcgtgatgcattcgaacgagtgctacataccagcgttttgagtgtgctacgccttcccctgtcccactaataggcccggcatttactgattttggtttcgttaaaatcatatttttttaccccatgtgattccgttacttcttaggtaacggataacacacatataggatacacatagcagtgaaaaaaggaaaaaaatcgattatgagggaatataaaagcgggtacctaacattcaatataagacttttttgaatttaggtaataaaaatcccttgagcatgaagatgttatctttcatgttcagatagattcatgttgcatatttgagagaaaaaggaaaaaaagaagttttttgcttgtttgctattaatatttttacctatctttgtagcgaatatatttccgttacctaagaagtaacaccagcattaagtccctaatccataatgctttaataatattaatcagaacattttaaaactacatacgtaagaataattcaatttattaacctttgttctttcttccaattcgaaaccctttaaatatatctgtgttgttttaatagatttgtgccctaatgattcgctaatcatctcgataggaacacctctgtacttggcagtcgtagcccaagaatgacgaagcgtgtaagacgtgacggatgaagatatccttaattttctggacaggcttttcaaatcattattgaaacgtctcaaggctgactgatattcacgataagcttcctcttcctctctcttatatgctccgcttaatatccgaaaaagataatcaggataatcgggactccgcgcatcggttttattatataatcctccgattgcattgtgcgctgactccaacacttctatactcataggagtaccagtcttgagacggttgtactttaaaagaccttgtttcaaattggacttttccaaatgggccaaatcagaaaaaggcattccacaaaactgaaataacagattggcaatagcctgtgtccggcgaagcttttccaattgaggatctttgtttagtaatatgtgaagttcaccgatcgggatggctttcttctgacgtgtgtccaccccggtaaatacatcccggaacaagccatgtacataaggagcctgatgcgtatcgactccgcgattgtagatactacgaagcatacgcatatacgtagaaatcgtattaggcttcaaacgggaagccaacagatagttgctatacctctttagagtttcgcggtttatcctactgaacgtaatggattgggtcccacaaaactgcgaaaaagaacgaatagcgtgtttatacacgtgggccgtagaataacgaccctcttgtcgcaaacaatcgatgtaattgtttgcacaaatagtaaatcgatttttttccataaattataacttatctcataagtgttattaaaaaacgtgcggaatatagtaagattatagataaaatgaatcacatttttaaatttagtcactgttttagatggaaaatcgaataatttctaaaaaaaataagtgaagccatgcagtattttcaataagcgtgcatttaacttataaaagaggggaaaaagggaaatcaaaccatatatcattaaaacctacaacctgagcttaacaagtgaagtggggaaaaataaaaaaagagagagagttttttatacaacgtcccccaaaacgaggaatccctgccaattttcgagttggcagggattcatttttacttatgttgttttcgaagaggcaatctcttacttgcagtatttggtaatcagctcatctacatttggatcacccagttctttcgctttcttaaagttgccacaagcttcatctgtcttcttcaactgtatctggcaaagccccagtaagcggtaagcctcggcatatttaggatcagccttcagtatattatccaaaatctgaatagcttcttcataacgtcctacacgcaggttgaccactgcatgttccgcctgataggtcaggtctgtcggattcatttcgattgctttaactatatcatccaaggcgcgttggaattggcgtgctttcaaagcggcctgttcgcgatagtaatagaatacgtcgttcacttctcctttgactgctgtatgataagcatcataatcgagcatcgcattccgtggctggccggcattcatgttcatctgcgcacgttccaacaaatatggagcaaaatctgctgtgatcggttgcgggcaacgggcaatacagctatccattaaagctacgacttctttcgggtcacctttcgccagttccttcgtcttggcagcactaaagaaagtggccggagaagcaatgttactggcatttaccttttcataagctgccaaagcaccggcatagtcttgctgggcaaacagtatatcgccttccatttgaatataaataggcagcggatcaatggcgattgcctgacgaacattctgcaaagcagtgtcatacgtccagtctttatacgttttttccggcttcgacaattgataagcatacatcagcttacctatattataatatacatcatcttttttctgggctactttcaaagcctgattaaagtcggcaactgctttatcataccaagtctggtcgtccttacctttagctgcataataattggcacgacgaagataaccatccgcattggcagggaactgacggatgaaatcatccaacagcttttcgtaatcgtcgcctgacaggctcgaagatgccataaacaagtacactaatgcttggtcttccgtttcgggcaggcctttccggatgccaatctttttcaaagcagcgtctcccaaagaaagagcactgattttctgtgacatggcaaaagctgctcctgccgcgtagcaagtggtcaccgtatcaatgccggatgatttctgcgcaataccaaatacctgaccttcagcgttcatcaccggacagctcaccatcttatctttcatctgcatacccaatgtatagtaatgatattctccggctactttggaaacttctttcactttaccagtaacgcaagcgatacttttctgtgtagaataaggaagcatccacgcatcggctcccactgccggagctattttagccacaatgagcgcaggcactttcttctcggtgatagccacacggaacttaatgacatcatacatatcattcgctccaagtatcaagctaaccggcatctgcttgccttcggaagtgataaccactgcacgttcggctcctttaaaaagagtataatctgataaagccaatccatcttcggatacaaaaaatccgtttccggtattcagcattttatcattcttgtcataagtcaccacagagaagactgcccgttttgccttctctacccatttgggagtttgcgccatgcttccctgtatcaggaagaaaagcagtaaaggtagaattaaaatcttcttcatatcagtcattatttctttgtttcacagcttcgtaaaccaagataccggcagccacggaaacattcagagattcgatggtgcccagcatcggaattttcacccattcgtcgcagagcgcaaggttttcataagaaactcccgtatcctccgctcccataatgatgcacagcggtcctgtataatcggcttttgtatagtcgtaatctcccttctcggtagcagctacaatacggaaaccactgtctttcagatattgcagcgttgaacggaggttctgctcacgacacacaggcagcgtgtgcagcgctcctgccgatgttttcacggcatcagcattgacagacgcactcccgcggacaggaataatcactgcatcgacagctgcacattcgcaggtacgggcaatggctccgaaattacgtacatcggtcactccgtccagcataacaaaaaacggattcttcccttgttcgaacaagaaaggaacaagatcttccgttttctgataagtcacagaagaaatgaaagcaatcactccctgatgatttttccgggtaatgcggttaatacgttctaccggaacacgctgaaccggtatcatcagccctttcaaagcagcaaacaattctttggaaagatcactctgaatgtctttctttaccagaattttatcaatctctttacctgcctgaatggcttctatcacggcacgaacaccgaaaatcatttcacttttatccaacatctatttgatttactattttactatttacaatttactacttatcagttaccgcttaacaattcactacctcaactactttgaatgaatcaatttagccattaattacttagcatcaagcagggatttggcattgctaagggcggcctcggtcagagtggcgccactaagcatgtgagctatttcctctactcgttcttcatcggtgagacggcggatatgactgtttgtttccgtatcgctgtctttcttatatactttataatgtgcacgtccgcgggcagcaatctgcggcaagtgggtgatgctgattacctgacggttccggtcgcccatttcctgcatcatgtccgccatgcggtcggctatttcaccggaaacaccggtatctatttcatcaaatacgatagtcggcagtttcacggctccggcaatcaatgctttgatagaaagcatgacacgggcaatttcacctcccgaagctacggaagagatattctgcaaggtaccattcttattggcagaaaacaggaagttgactgtatcttctccttgcaatcccggctctttcttcagtcccatttcgatctggaaacgaacattcggcattcccaacggaatcaagcgggcggccaattgcttttccacttcacgcgcagctttcgtacgggctttggtgagcagttctgcttgttgtttcacttgcttatattgttcctctttacgaacggtcagctcggcaatacgttcatcgtatgaagtgatgtctgacaatttgctacgatattcatccgtcaacgctatcaactcgtcaagagtctgtgcccggtgtttctgttgcagggaataaatcagattcagccgttcgttcacttcttccaggcggaccggattaaattcaacggaatcactttgcgaagagacttcgtgcgaaatatctttcaattcgatataggcgctctccatacgttcggtaagttccttagcgggctgatagactctttgcaggctattcagcgtattcagactatctttcaggtaagaaagcaatccgccttcatccgagacaaatgactgttctacccggtaaagtccggctttaatctcctccgcatgacttagtgtttcggcttcctgctccaattcctcttgctctccttctacaagatgggcctcttcgagctgttcaagttggaaacggatataatcttcatcggaacggcttttctctgccagtgacattaattcagccagttcgcgttctgtctgcttccattcgccataacgcagatggtatttctccaatgctgcatcattatgtgccagaatatcaagcacgttcaactggaatccttctttattaagtaacagattctgatgttgagaatgtacatctatcaattgttcgcccagctctttcatttgtgccagtgaagcgggagtatcattgatgaatgccctgcttttgccggaagcctgtacctcacgacgcaaaatacactcttcatcatattccaattcgttttcttcaaaaaacggacgcataccgtaggcagcaatatcgaaccgtgcctctataatacatttggaagctccgcgacgaatcgctttcacatcggcacgctgccccagcaggagcccaatagctcccagaataattgatttcccggctcccgtttcacctgttataacggaaaagcctgtttcaaaactgatatccagtttttctatcaatgcgtaattctgaatgtatagtgaacgtaacaaactaattaaaaattaaaatttgaaaattaaaaattgggagacagggtggctaccagacgatcaatgatgtcttgagctacttctgttttcgacttcagaggatagtctgtacgacctttcctgtcgattatacttatcttattggtatcatggcggaaaccggctcctgcatcattcaacgagttgagcacgataaaatcgaagttcttgcgttcgagctttccttcggcattctgctgctcattattggtttcgagcgcaaagccaaccaggcattgttgttttctttttatggctcctaaagaggcagcaatatcttgtgttgcctgaagatgcagggtcagttcttcttctttttcccgcttaatcttcttatcggctaccgttgccggacgatagtcggctactgccgcacaaagaataccggcatcagcatccgggaaatgagcctgcgctgctttgtacatttcttcagcagattcgacatcgacacggatgataccagaatgttgcgttttgagttgcacaggacctgttatcaaggtcacttgtgctccgcgacgggcacattcttctgccaacgcgaatcccatctttccggacgaataattgccgatgaaacgcaccgggtctatcttttcgtaagtcggtccggcagtaatcatcactttctttccggacagttcgtcactcgaagcaaagaattcatccaatacccggatgatattctccggctcttccattcgccccttccctaccagatggctggctagttctcctgtccccggctcgataatatgattaccataggaacgcagaatatccagatttttctgggtggcaggatgggcaaacatatcgaggtccattgccggagcaacaaacacgggagcttttgccgaaagataagtggttatcagcatattgtcggctattccgttggccattttaccgatggtagaggcagtggccggcgcaatcaatacggcatccgcccataaaccgagatcgacgtggctgttccacgttccgtcacgttgggcaaaaaactcactgatgaccggtttgctggtcaaagccgaaagagtgatcggagtaataaattcttttcccgccggagtaattacgacctgcacttccgctccttgttttatcagtccgcgaatgatatagcacgccttatacgcggcaatactgccggtaattccaagaattattttctttccttttagcattattttgtaatcaaattactcatttcacgcaagcggatttttgtcaatgccgccttggtgttcagcgtgaaatcactattcaaaatccaactgtaatatccgggatctttcttcaaaacctcggctacagacattcccttatattttccgaagttgaacacttctactccgttatcatcgtacaccatgcgtccggcaaaatcgacattcttgctgaaacttgaataatctgccaggaacgcaatatcattctgaagatcggagtaacggtcgagctgcgctttcaacacttcgtaagtagcccgtgtatctgcttcggcagtgtgcgcatcttccaaattcttgtcgcaatagaacttgtaggcagcagacagggtgcgttgttccattttgtggaagatgacctgtacgtctacaaatttacgttttgtcatatcaatatctactccggcacgaagaaattcttcggcaagaacaggaatatcaaaacggttggaattaaatcctgccaaatcgcaaccttcaatgtcacgggctatgtttttcgctacttctttaaaagtaggacaatctgctacatcggcatcataaataccatgtatagcagaggatgcttccggaatatgcatttcaggattgatacgtaatgtctttgcttcttcatttccattcggatatactttcagatagcaaatttcaacaattcggtctgtgttgatattggttccggttgtttctaaatcaaaaaaaacaatgggatttttcaggtttaatttcatttctgtttattttattgagtcaccacagattaacacagattcacacagattttacttcttctaaagaaaaaacatctgtgtgaatctgtgttaatctgtggtgaaacgtattaatcatttagcatcatcggcatcagcagcatcagcaagtcttcgttttcttcctgctctaccggaatgattactccggcacgtgaaggatctgcaagttcgatgactacttcatctgccgaaatattgttcagtatgtcgataaggaacgtcgatttaaaaccgatactcattgcagcacctgcatactggcaaacttgtgtttcttcggcagaagtagagaaatcaatatcttgtgcggaaatcacaatctggttttcctgcatacgaagtttaatcaaactgctggcttgtgacgagaagatagacacacggcgcaaagctcctaccaactgttggcggtctacggttactttgtgcgggttgttttgcggaattaccgagttgtagttcgggtaacgtccttcaatcaggcggcaaaccatccggtagctttcaagcatgaatacagcgttgcgttcgtcaaattcgatggtcactgcgccttgttctttcggcaaaagattctttagcaatgtagccggtttctttggaaggatgaaggctgcacgctcgttgcctttggctgccaacgttttacaacgcaccagtttatgaccgtccgaagcaaccattgtaatgtcttctgttgtaatatcgaaataaataccgttcatcaccggacgaagttcatcatcggcagtagcaaacaccgaacggttgatacctcccagaagtacgcttgcttccatttccacgcggacagcattatcccccagtgtagccgattgcgggaattcatccgcattctgccccatcaggctgtattttccgttctggtactgcaccgttatttcataattatccggattgatatcgaatgtgagtggttgttccggaatttctttcagtgcgtcaagcaatgttttcgctactacggcaaaacgcccgttcgtatcgctttcattcacttctacggtagtcaccatcgttgtttcactgtcggatacagtcacagataatgttccgtcttccaattcgaagaggaaacaatcgagaattggcagcgcattttttgaattaataacacggctgatggcctgtaaatggctggaaagagcagtacttgaaacgataaatttcatatattttcgtgtatttaagttttaaatgttctatcgcacaaagttacgaaaaaagatttgggctgcccaataaaaacaaaagaaaaaaacaggtattgtgcgagggatattactaaaaaattgtaacttcgccgcagaatttaaaattatcgcaatggaatttacaggaaaaatcatcgctatcctccccccgagaggcggagtttcaaaaactagcggcaacgagtggaaatcacaagagtacgttatcgaaaaccacgaccaatatccgcgcaaaatgtgcttcgacgtatttggcgcagacaaaatcgagcagttcaacattcaaatgggcgaagaattgactgtatcattcgacgttgacgcccgtcagtggaatgatcgctggttcaatagtatccgcgcatggaaagtagagcgtgttagcacaggtgctccaatggcttccggttctcccgttcctcctccagctccatcggctatgccggaatttactccgggcgatgccaaagacgatctgccattctaaaccgaaagtcattcgttcgatgaataagcataaaaaactcccgataggattaaactccatcgggagtttttttatctccttttctcccgaaaaaaaacaaatctttttcttcttctttttcatcttcagaagaagaagtttttttatttatttctttgtttataatgggggatgaatttttctgtatattttacgtattttctgtgaatttttctgtatattttacagattcaaatgttaaaatcactcataataagctgaccataggactattataagcacacatataaaaacggcaaaaatgcaaaaagaaaaaaaacaaaaaggcgtttctccaaaagcagaacgcacacaaaaaagtatgggtcaatggagcaaaaaaaacgataaacagcatcttgaaaatgtatggaggaagcaggcaaagtttatggataatccagccaaaagctatggaggttttcagaaaaatgatcgcagacaaacgatgattttttattctgatttatatttcaaaacaatattaggatataccattccgtctgcacaggcaaactgaacaaagagggtgaaatgacggaagaagtcggcgttgcgcagaaagaaatccggtacaaaacgaacgtgattttctgattgttggaatatgtggtcgaaatccgccatcagcataaaatggtaggaatcggacaaatgatccatgcctgtctgataggccatcgctccattgagcacctcacctttatccagttggcgaatataatgcgcgagagcatccgcatcaggagcgagcaacaagcgcccgccatagaaggctgcatatacatccaaggttggttccgcaaaactggttagttgttcaaacaatgttgtttgaggtaaccgatagataggatatgctttatttacagtataacaaaaagttatacgcggatttcttcttccttcgtccgccgaagcggcattaacaagggcacgaagcattcgctcggcttccgttacatctgccaccgacaggctcaagactgccgctgcaccctgcaaagtatcttcacgctgaaagagacaggcaaccaaatcctgcccggcattttccatcagatagcgtgaaaactctttatccctattttgcacttcactcgtgcgggcaggcacgctctgtccttgggcatttccataagaaagtagagacacccagtccgtaatcccttgcctgctaaaatagaaagcagtagacggtaacacttctcccggaaatcccttgacggattgttgctggcgaagctggtttataaacgcaaagcaagtgtctgcatcgtgagtgatgccggagaaatagatgaaatcatctttcattttcatgtcaaattccgtccatcccatcatcccttgcatacgggtatagatggtagcggccgccgcactttttttcggagcacgtattcctgtaaaggtagaatcatcagccaacgattttccacttttatacgcatcaataacgttttcaatcagttttttctgaaagctcaatgccataaaatcggatgtcagatagcaggcaagaaaatcaccgtccgccatgggataaataattatctcttctcctttgtaaataaacgttttcggcggataaagtgaggatatatatttgcgtacaaatctgtttaccaactccttatctccatttcccaatctgcaatagagcacttgattacgttcgttatccggctcgtggaaactaatcaacatttgattcatttgccggcttaaaccgtggggagtatcttctgaaagggcgtaaagactctgtttcagataagaaaagagtttggatacataaagatattgctgatttttactacaagtcagctcatcgacttctgctacaaattcgagcacgtcatcagtaacgaatactgctaaagttgtggatggcaccagttcataaagattaaagtctttctgcccttcagctgctgacagtctaaaaaaagagtacaatgcgaaacctgagcacaaaagtacaacagaagatgtgatcgctattttcactatcgtacgaagtttcataatattcgctgtttatcggctaggtgcaaaaataataatttctacaaagaaaacaaaacttttgctaaaaatttcaccgatattcaaacatagatatccaatccgtcgaacgccaagtgaatattttccggaaggttcttttcaacctccgcatgcaagcccatatcatgactcatgtgtataaagtatgtcttctttgcctgaatacgccgggccaccgccaatgcttcttccaaattttggtgagtaggatgcgaggcgatccgaagcgcattcattatcaaaacatctattcctgccaattgttcataggattcttcgggcatggtcaacatatcagtgatataccccaactgcccgatacgataccccagaatcggcagtcggccatgcatcacacgcagaggaagcacttccgtgtggtttacagcaaaggattgccccaccgaaatttcctgtaaaggaatatcgggaacacccggataacgatgatcgacaaagcaatagggcatacgcaaacgcaatccctgcgctacataatcttccgcataaataggcacggaaccgaaccggcaaaacggacgtaaatcgtccagtccgcctacatggtcataatgttcgtgcgtaatgagcacaccatctatcctctcaaaagggagatgtaatacctgtgtccggaaatcgggaccacaatctatcagaatccgcgcgtcatctgtctccacaatagcagaggcacgcaatcgattatctttcggatcggaagaagtacaaaccggacatgtacagccgatttgaggtactcccgtcgatgttccacttcctataattcttactttcacttgtttattctcaatttataaagttgacttccggatggatatcaataccgaacttctcacgaacagaagctcggaccgcatctgaaagtgcaataatatcactaccttttgctccgccacgattcaccagcaccagtgcttgtttatcatgcacagcagccggtcccaaggcttttcctttccaaccacattggtcaatcatccaccctgccggaatttttacgcggccgtcggccagctcatagtaaggtatgcggggatattcctgttgcaaggcttccagtttttctttcggcacaatggggttcataaagaaactgccggcattacccatcactttcggatcgggcagcttgctctcgcgaatagcaataatcactttccggacaacagaaagtgtcaacgacggatatttttcaagctcctgacgaatggtgccatagtctaatgtataatgttcttctttacttagccggaaacggacataagtaacaaaagccgatttgttttccgaacgcttaaaaatactgttgcgataggtatatccacattcaccaactgaataaacgcgttcttcagcttgaatgttcactgtttccacagccgttatcagatcttttacctcaacgccataggctccgatattctgtactgcacttgcccccacctcaccgggaatcagcgacaggttctccgctccataccatccatgctctacacaataagctacaaagtcatcccataccacccctgctcccactcgcactgatacagagtgagcatcttcttccgtcacttcgattccttcaatgcgggaatgcaatatcaacccgtcgtaatctttggtaaacaacaggttactgccaccaccaatatgcaaaaaaggtgtcgtaacggcaccttgcacaatcagcttcttcagttcttcaaccgaagtgtactctaaaaaacgagcggcactgacatcaataccgaatgtattgtagggtaaaagagaatacatatatttttaattataagttatatcattattcgttataagccggcaaatactgttatatcattaacagcaaggctatttcttgtagcgtattactacctgcatcaaatgcttgtatcttcaaacttatacaattcccattccccggctttgcgacggaaatagaggatattggaaaaaccattaccgatacctttcaacgccagaattttcgttggcgaatcatcgtcattccgctgcccgtaattgatattagaaagacgatcggcaggaagtcccggtttaaaagcgaaccactgattaagatcgagggtggtctccagaatagagaaatcatcgtccggatcggtggttacaaaagccagaggctcacacacacgcttactctgaaaaagactatctgcggcaaagtgtccgaaaaactccacgaaattttcattatcattttgcttaatgggacgcagattaattgcctctagcatccatgcacctttgatacgctcaaaatagtatttctttaccattcgtgttttcacaaacacccattctacctgtacggaagtgagggaggtatctcctactaaatccatatcttcttctctatcaaacagaagcgtataataatgctgtttggtaaacaagtcatcatgcttccagttatgctcctcgatattcgtttttttatctccattgtagtaaggcaacggaaatttcacacgctgacgctgcaacacgtcatcggaagcaaaattgtagataaaatcatcgaaagattcatctgcctgtataggttgcggatcttccggcgattcatcacagtgaatagaatcggctacccgccggatagaatccacttcttttgtgatagatgcgaaggggtcaatgtttgttttcttgtttccacaagcacccagtataccgagcaacatgccccctacaattagttttttcattattttagtttctctcttaacttttcaagcatatctaccgtcatgctttccaaatcgtaggccggcttccagccccactcttcacgagcgcaggtgtcatccagactatcgggccagctatcggcaatgcgctgtttcaaaggatctatatcatagatcatctcaaactgcggcacatgcttcctgatagcctgataaatcgtctccgggtcgaaactcattgaggcgatattgaaagcatttcggtgtatcaattttgtcggatcagcttccatcagcgtaattgctgcgttcagcgcatccggcatgtacatcatatccatcaaagtgccttgcttaatggggcacacaaatttttctcctttcaccgccgagtaataaatatcgacagcataatcggtcgtacctcctcccggaggggtcacattcgaaataatgcccggaaaacggacagcacgtgtatcgacaccatatttattaaaatagtagtcacttagcagctcggtcgttaccttggtgactccatacatggtgcgcggacgctgaatagtgtcctgcggtgttttcgtatgaggcgtactagcgccaaacgaaccgatagaactcggagtaaacactgcacatccttgttcgcgtgccacttccaatacattccataatccatcgatacctattttccaggccagcttgggcttcgactcggcaactacggacagcagagcagccaaattataaattgtatcgatgtgatactcttttaccacagatgcaatcgcctctccatccgttacatcagcaattgctgacggtccggactcctttaattcccctttaggctctgcacccggaatataacctgctactacatttgcatttccgtaacgtttacgtagctccatcgttagctccgaccctatctgtccggtagctccaataatcaaaatgtgttccattttttcttctgacttagaatatcaagcttaaatagtgcgcaaagtaagcacttttttttcagattttaatcaaaaagacattgttattccaagaaaaattgtgtcctttgcaatataacttaatcacccaaacactatgtacggtaaaatgcaagaatatctccgccaaacattggctgaaatcaaggaagccggactttataaagaagaacgactgattgaaagtgcgcagcaagctgccatcactgtaaaaggtaaggaagtgctgaacttctgtgcaaataattacttaggattatccaatcacccgcgattgattaaggcttcgcaggaaatgatgaataaccgtggttacggaatgtcgtccgtccgcttcatttgtggaacgcaagatatacacaaagaactggaagctgccatctcggagtatttccaaacggaagacacgatcttgtacgccgcttgcttcgatgctaacggcggtgtattcgaaccgcttttctctgaagaggatgccatcatctcggattctctgaatcatgcttctatcattgacggagtacgtctttgcaaggcaaagcgctaccgttatgccaacgctgacatgaaggacttggaaagatgtctgcaagaagcgcaggcacaacgtttccgtattgttgtgacggacggtgtgttctctatggacggcaatgtagctccaatggatcagatttgcgatcttgccgagaaatacgatgcactggtaatggtggacgagtcacactctgccggtgtggtaggtgccacagggcatggagtaagcgagttgtataagactcatggacgggtagatatttataccggaacattaggtaaggcttttggcggtgcactgggaggtttcaccaccggtcgtaaagagattatcgatttgcttcgtcaacgcagccgcccgtatctgttctcgaattctttggctccgggcatcattggtgccagccttgaagttttcaaaatgctgaaagagagcaatgcattacatgataaacttgttgagaatgtaaactacttccgtgataagatgacagctgccggatttgatatcaaaccgacacaaagcgctatctgtgccgttatgttgtatgacgcgaagttgtcccagatttacgctgcacgtatgcaggaggaaggcatctatgtgacaggtttctattatccggtagtgccgaaagatcaggcacgcatccgtgtgcaaatctctgcagggcacgagaaagcacatcttgacaagtgcatcgctgcctttatcaaggtaggcaaagagcttaatgtgctgaaagcggaataactccggggcaaggtttacttgcagcatccatttttaggcacggattacacagattacgctgctgctttatgcaagcatatttctaaaaccgtgaaatccgtgtaacccgtgccaaaaaattctcttttataaaatgaattttgaaccgctacttgactataaaaaaaagattatggaagaattgactctcactactcctgccctacttttctcggcagtttcattgatattgctggcttatactaaccgtttcttatcgtatgcccaacttgtgcgccaactgcgtgaccgctacatggaaaacccttcggatatcactgaagcacaaatcgagaatctacggaaacggttaaacctgacccgtagaatgcaaggactaggtattgcaagcctttttttctgtgtagtcagcatgttccttatttatatcgggcttcaattattctctgcttatgtattcggattggcattgattctgctgatagcttctttaggcgtatctttccgcgaaatacagatttccacccgttcactggagatttacctgggaacgatggagaaaggaaaaaacaagaaataagattgttcgtattcccgttaaagtctatcattatcaagataccacccggcaaggaagaataaccgtaaaacggcttcccttgcctacttcggacttgagttcgatctttccacccagcttctctataatcacctgacaaatagaaagtcccaatcctgctccctgcgaaaattcgttttgtttgtagaaacggctgaaaatcatccgttgttcttctcgcggaatccctcttccggtatcttctacataaatctgcactttgccttcatccggcagataactatatcctaatttgatatatccggtttccgtaaacttgcaggcgttattcagaaagtttgtcagaacttgtatcaagcgctctctgtccacattgatttccagaggtgtatcatccacttctttcaggaattccaaatgtggagcaatcagaacctgatgtgtcatatagatatcgtcaatcaactctctcaccttgcatctcttgaatgagaaagacatatatcctgattcgatacgggaaagttccaagatatcattaatcagtttgagtaataactcgctgttcttgttaatagtactgatatactcttcgcgttctacggaactcaatccatcttccaatgccagtatattggcaaagccaacgattgaattaagcggagtacgtatctcatggctcatatttgcgaggaatgattgtttcaattccgccttttcagccaataagcgtgctgcttccaattcttcttcacgatcttttatatcctgtatattaagcaacaaacctgcggttttatattcgcctccgggtagctgtttggtagtataacggaactcccaccactgatagcctttgccgtcgaagttacaaagctcctgcacaatctttttatgagcacttttcagatttcgccagttgaacttcactccttcccaatggtcgggatggataaagctcatgaattccttaaacgaaagttgtctggaatttaacccttgcgacgcccagaatgcatcttcaaaaacaaaacaaccgttatccaatctccaggcatacgtcattccaccctcaatggctaatgacaatgtttctttttcatcagccaatgctataagagcctgctttttcctcatctgttcccgaaggtatagccaccaaagagaagcgaaaagaataattaatataagaatgaacgatgcgactgaaattccccacaacaaagggtatttatcactaaacggaatattgataatacgatatttagcaggaatactttccttactcaaacctatttgcgtcattgtattccaatcaacaacatactctttccggctttcaacaataggcatgtccgccggactcacaccgtgtaatatacgaacggctgctttcacctcttcttccacctgaataggcaacgaggtgatgtatccacccaacaacttctcaccaaacccgaaggcttcattgatagctgtcaagctgggactgccacaaatgcttccaatattaatggtagtataatcccgtttcagctgaatatagcattgatcgcgatagcttctgttcaacacccacataaaggtggcgtccgaatgatttctggcattacgtaaaggaatagccatgaaacgagtataaccttcctcctgcgtcaaacgtatctgttcttcaagagaaagttcggggttatcgacgaatccggtcactttatgacctttaaactgttcctttgcatctcttctgatttgtttatcgatataagtggtatcaagcatggtaaacaaccggacgtgttcaccgaaaagttcttttgccacactgacattttcattaaaggcaatcttatcatggaaacccgtcacattaggatggcgtttcagcaatccccaattcgggtaattgacaccaccaaaaaccacaggtacttctttgcccaactgaaccccacatttcatcaatgaataggtagcctgatcttcattcaccagaatcacttccggccgccagtctttcgaaacggaatcaaccagaaaacgcattcgttccaactccggttcttccctgtaggactcgcaatctaaataaacggtacggatatcagcatctattttctctttctcaaattgctccgctatcatccggttaaattccggataagccgcgtaagtctcctcataagagtggataactaaaatacgccgttcctctttttgagaacaactgctcacccccaaaaagagcaataaaaatatagggagcaatctaaaaattcctctgttcacaccattcatttataataatcgggattaatttctctctgactcttaatacaaaggtagtttatttccagatacgagccaaataagtgaaaaaaaagaagctacttgaagaaatttcgagtagcttctttctatataaaaaactattttttcagagtagcatcattaacgctgtcccaattgtgaatctacaaagaaaattccagtatcaccggctttcttgattttatcaacaatgccttgcgctgtagcttcttcttctacctgttcacgaacaaatccccacaagaaatcctgtgttgctttatccttttcagcagctgctacgtctaccagcttgtctaccaattgagaaacatgacattcatgtttgtaaacgtgttcgaatacttcgagaggtgtaccccatccgttaggaacaacatctattttatccactttagcagttcctccacgtttgatgatataatctgccattgcataagcatgtcccatttcttcctgggattgctttttcatccaatgagcaaaaccactgaaaccttctttctcaaaatagaaagacattgctaaatacaggttagcagaccacatttcagcagtaatctgttcgttaattgcattctgtaatttttctgaaatcataatcgtatttttttattaagttgttaatgtagtttctttttgaactcattacaaaaataacacgctttcagttaaaattgttccatgcaccctatatttttaaactacattcacattttgattgtagcagttcattttttacttacaccaattcgtcggaagtatatcctttcggcagttcacgacagttgtatccggaagccattatttcaccgtacgcaccggcagaacgaagggcgatcaagtcaccacgcttcactttgttcaagtcaatcgcttttccgaaaacgtctgacgattcacagatcggtcctactacatcgtaggcttccaacggttcttcagaagttatattttccattttatggaatgcctgatacaaagccggacgaatcaggtcggtcatacctgcatcaaggatggcaaatttcttccgtgttccttgttttacatagaggactttggatatcaaagaaccacactgacctaccactgcacgtcccagttcaaaatgcagtgtctgataaggacgcaatttcaattgtccggcataggtagcaaagtaatccttgaaattcgggacagcctgacggttggggtgtccgtaatcaatacccaaaccaccacctacattgatatgttctaccaaaattcttcgtgcttccagtttgtcctgcaactcattgacacgattgcagagggctacgaaatcacccatatccagaatctgcgagccaatgtgaaagtgaagaccgataaactttacgtttttcatctcttgtgctacgtctatcaccttgtccatgtcctgcatactgataccgaatttgttttctgccaaaccggtagttatattggcatgtgtatgtgcgccgacatcaggattgatacgaaaagcaacattagcaatcttattttgagcagcagccaattcattgattacttccagttcgggaatagactcgacattgaaacagaagataccatactccagtccgagattgatttcccaatctgctttgccgactcctgcgaaaacaactttattggcagggaatccggcacggatagcggcacggatttctccgccgctcacacaatcggctcccattccgctctcacggataatggtaagtactttcgggttggcattggctttaacagcgtaatgcactgaataattaggatatttggcaacctcctggttaatagccgacaatgtatcacgcagcactttggtatcgtaataatagaaaggtgtctgcaaagtgcggaatttatcgattggaaatattcccttcataattcgaaaaacttgtttagttggttaaaaaagagcgcttttatcagttcggtaaaagcgctcgtgttatttgtggatttatttgtcgttgaaaagcatatcactcaacgactgtaaagctactttcttatcgcactcccgaatgaggaaggagatattgtagttacttcctccgaacgagatcattcgcaccggtatattccgcatcgcatcaagagctttcgcttcaaaaccgacattttcccattcaaggtcacctacaacgcagatgatacacatctctttatcaacggttactgttccgtatttcttcaggtcatccagaatttcgttcagatgcttcgtgttatcgattgttacagatacacctacctctgaagtacagatcatgtcgatagacgtctgatagctttcgaagatttcgaataccttacgcaggaaaccgtgagccaataacatacggctggatttgatcttgatcgcagtaatgttttcttttgcggccactgccttgattttacctttttccgtgtcgttggaaatcagtgtgcccggagcttccggatccattgtgttcaacagacgaacagggatattggcatatttagcaggctggatgcaggtagggtgcaggatttttgcaccgaagtaagccaactcggctgcttcttcgaagtgaagctgacgaaccggagcggtcttgtcaacaatacgcgggtcgttattgtgcataccgtcgatatctgtccaaatctggatttcagaagcgtttactgcggctccaatcaaagaagcagtgtagtcactaccaccacgttgcagattgtctatctcaccgtaagcattgcggcagatgaaaccttgcgtaatgtagatttctgtatccggatagagatcgagctgtgcgcgcaatttatccttaatatatacaggatccggctctgcgttcttgtcagtacgcatgaattccaaagctggaagcaacacggacttcacgccacattcctgcaggtagaagtttaccatcgccgtagaaataagctctccctgtgccaaaaccactttctcttcgaacaaagtgaaaaggtctttagtataggagcggatgtagtcgaagtgggatttgacaacttcaagacctttctgtttatattcctgggttgcaaaaagttcatcaatgtgctgtttatattttgcttccagcttattgataatctcgttggcaccctccggattcttcttatacagatagtccgaaatttccaccaatgtgtttgttgttcctgacatagcagaaagaacaacaatcttctgttcaccatcggtaatcaatttggctacttccttcatgcgctgagcagaacctacggaagttcctccaaactttaaaactttcattttcgttactgttttagttatctatatttaaatctatttctattgttctctgtctgagcatgtattcggctgtcacatctacaatctgatggtcggcgcaacgatataccctgcccggatactctttcagcaattgcaaattgtgcgtcgtcatcactacggatgaaccggattcacagatattgtgcaacaattctacaatggccttaccggtctctacgtccagatttccggtcggttcatccgctagaataatagcaggagaattgagtacggcacgtgcaatcacaatgcgctgttgctcgccaccggaaagctcgttcgggagcttataacctttgttggacattcccaccagctggagcacttcttcaatgcggtcttggatttcctgtttgtttttccagcctgtggcacgaagcacaaattccagattattatatacagtacggtctgtgagcaactgaaaatcctgaaagacaatgcctaatttccgacgcagttgcgggatatgcttacgtttgatagaacgcatgttataacccaacacttccgcttcaccgtcaattacgtccacttcgccatacagagtcttgagcaaactcgtttttcccgagcctacttttccgatcaaatagacgaactctcctttgtgcagttccagatttacatcgcttaatacacagagttcctgttgatggatttctacgttcttatattgaatcaacgcctcgtcatccatgctgactcccgttttaatttttaattattaaattttaattgtttaatgcttcttccatgtactgctgtgtctttcctgcaattcacgtgcaaggtcttcgagacgatagccttttgaagtaagcaatacaatcatgtgataaataaggtcggctccttcgtagatcaaacgttcgtcagtaccgtttgttgcttcgattactgtttctacagcttcttcacctactttttgagctattttattgattcccgactcaaacagactggtagtataagagccttcgggcatttcttcatgacgtttgtcaatgaaatcttgcaatgctttcaggaacataaccggttcttcgtttttctcaccccaacaagtatctgtaccagtatgacacacgggacctaccgggtttacctgaatcagtagtgtatcattgtcgcaatcggcctttatagataccacatgaaggaagttaccgctttcttcgccttttgtccacaaacgattcttggtacggctaaagaatgtaacttttccggtttctactgttttatcataagcttctttattcatgaagcccagcatcaagactttacgtgtctcgttgtcctgtatgatagccggaacgagtccgttcattttatcgaaatccaattccatttttatataagttctaattactattccaaattacaattatgttctattcgcctatggagtttttttgcaaatatcttattctatttatctaaatagattattcatccgcatggaaacccggccggggtgcctcaccccctgatggtaattccttcgccgcagcctaaaggctaatttttgctacgcagcaattacctagtggtaattccttcgccgcaaagatacgattttaattcgggaattttaatttctccgaagtgaaaaacgctggcagccaatgcagcatctgcctttccttgtaaaaagacatcgcggaagtgctctttacagcccgcacctcccgaagcaatgataggaatggaaagctgatccgccaaagcggcaagtgcatcatttgcataaccggcctttaccccatcgtgattcatgcttgtgaagagaatctctcctgctccgcgttcctgggcctcttttgtccactcgaacaggtctttatctgtttcgatacgtcctccattcaagtaacatttccaaccattttcggtttgtttggcatctactgccaacacacaaacttgcgaaccgaaattctttgcaatctcgtcaatcaattgaggattacggatagcggaagaattgatagagatcttatccgcccctgcattcaacaggcggtctacatcacttaattcgttgattccgccacctacggtaaatgggatattgatattagcagcaatccgttttaccaattccgtaaaagtcttacgtccttcatgacttgcagtaatatccaggaaaacaagttcatctgctccttgttcactgtaagcacggcctaactctaccggatcaccggcttggcgcaaattgacaaaattcgttcctttcacggtttgtccgtcttttatatccagacaaggtactattctttttgctaacacaatcctacttttatttattgttcaacaatttataatctatatccctgaagtttgattctttgttttctcttataataaggtagctatttataatataaacaaccatttcattctggtacgctaattataaaaagattctcaaatcttttaaggtgatatgtccttcgtataatgccttaccgaaaataactccgggaacaccagcttcatccaaagcaacaatatcatccaccttactcaccccgccactagccatcagatagaggtcagggaattttgccagcatctccttatacaaatcaatagaaggcccactcaacattccgtcacagctaatatccgtacagattaccttgcgtatacctttatccatatatttttcaagaaatggaaaaagctcacaggaactttcgtctttccaaccgttaacggctatcttatgatctttcacatctgctcccaaaatgattttctcactgccatatacttccagccaatgacagaacaattccggatctttcaccgcaatacttccgcctgtaaccatctgtgctccattctcaaaagcaattttcaaatcttcatcactctttactccaccaccaaaatcgataacgagagaagtgtgcgcagcaatccgttccaacacccgataattgactacatgatgagaagcagcaccgtccaagtctaccacatgaagcctgcgaacaccgttcgcttcaaactccttggcaacttccaccggattttcgttatatactttcttactgtcgtaatctccctgggaaagacgtacgcactttccgtcaataatatcaatggctggaataatttctatcatctattatttatttgctaaaagtttattataaacgatgaacgagtttattataaattatgatggagtttattataaacggcaacatagtttattatagattcaaaaagttcgtcagaatcttctctcctgtcttgccgcttttctccggatgaaactgggtggcataaaagttatctttatgcaatgcagcactaaacgggtgaatataatctgttgtagcagcagtaaagtcacaggtaggcacataaaagctatgtacaaaatagacaaactcttcttcagtgaatccttcaaacaatttgctattcgtttttccaatggtattccatcccatgtgcggcactttatcttcatgtttctgcggaacaaaacgcttcacgtccacaccaaagatattcaaacaatcgacctctccttcttcggaataccggcacatcaactgcataccgagacaaattccaaatacaggctgacggagattttttatcagttcgtccagtcccgttgctttcaagtggttcatggtagtttccgcctctcccactccggggaaaataactttatctgccgattggagttcttctttatcagcagtaatcaccgcttccacacccaaccgcttcaaagcataatccacagaacgaatattgccggcattgtattttacaactgctactttcatcagctaaatattactgttttatttttataagccaaaactttacgttcgatgtgcttctgtactgcacgtgaaagaacgattttttccaaatcctttcctttatttacaagatcttcaatagcgtccttatgagtaatacgcaccacgtcctgttcaataatcggtccggcatccaattcagtcgttacatagtgactggttgcaccgataatcttcacacctctctggaatgccgcatgataaggcttcgctcctacaaacgcaggaaggaaagagtgatgtatattaataatcttattcggataagcattaatcatctgctcggaaattacctgcatatagcgcgccaatacaataaatgtaatattatgcttggcaagcagttccatctccttacgctcctgttcttctttcgtctcctttgtgataggaaacagatagaaaggaattccgaaccgctctgctacatgctgcaaatccggatggttacttataataagaggtatttctacattccattctccggctgtatatcgtgccaatatatcgaaaagacaatgtgacagcttggaaacgaaaatagccatacgtggttttacatcagagaaataaaggcgaaaatccatttcatatttttgcccgtagagagttctgaaataatcttcaattttctcctgcggaaccagaaagtctttcagttcccattcaatacgcataaagaatatgttctctacatgatctacatattgatccagatagataatatttcctttgtttaccgtaataaagtctgtcacttccgcaaggattcccggtttgtcgggacagtgcaataacagtttggctgttgtcatcattctttttactaattaacgattctaggcggataattttccacctttcttattttagtccgcaaaaataacgatttattgcaaaattacgaattatccaagcataaagttgatataaaaacggtgatttcttacagatagaaagatatcgggagttattttctatgaatagaatgacaaacttcaggatagtgacgctatcctatcgtgatggcgtcactataacaaccggatagcgtcactatccgaagagaaaaaaaacaatatttttttcattacaaaagtactcaaaatgagacactaagcatttttatcgttttttcttgaaaaaaacttttctcaaaacgcttgcagatttacaaaaaacaactacctttgcacccgcaatcgagagagatgcagattaataaattgaaattctggtgcgttagttcagttggttagaatacatgcctgtcacgcatggggtcacgggttcgagtcccgtacgcaccgcttctttcattaagaagtaaaagagaatagaaatgagttaatccaattaaaatttggtgcgttagttcagttggttagaatacatgcctgtcacgcatggggtcacgggttcgagtcccgtacgcaccgcaatagacattggaaatcaatgttttacaaattaagcacccgattttacacccaagaatgtaaagttgggtgttttcgtattatttatgattataaagggagagtataaaagttttttgtcgatgcgttcataggatttatgtgcctgatgtttgccgggggtattgcttatgccatttatcacgccttgttcattgctgttgtccagcagaatatcgcttcggaaattctcgggcgcacgttttctttgatatttagtctgagcacgctctcttccttgttggggatattggtatcgggatatttggctgaaaacatgagtattgcaaccttgtttgtaatctgtgggacgctcattggagcggtcggagtagccgcgtgtttcatctcttcgataaaatctctgcaataacatatttatcacaaagacatcgtttattatgacaaaaaaagaacacattacgatttcagacttattccaaatattggatttattggaaagtacaggcgtgaagtattggctcgatggaggatggggcgtagatgccctgcatggagggcaaaccagaatccatagagatgtggatattgattttgacagccgttataccgacaaattgattgcctttcttcaggaaaatggtttcgtcatagaaacggactggcttcctgcgaggatggaattatacagcgtcgaattagggtatatagacatacacccgtttatattgaatgaggatggtacatccagacaagcggatttgcaaggtggttggtatgaatttcagtcggactattttggtgaaactactttggatggcagggttattccatgtatttcattgaaagggcaaaagatattccattcgggatatgaattgcgggataaggatattcatgacttatctattcttgatgctatttcaaaatcataattaaaagctggaggatcaattcccccagctttttcagccctcgttacatcataacttgaatcctctactttttcttggctcttctgtttttcgtaaaccttgccgaagtttctcccattgttctttgaaccattcgccaatcggttgcctgtttatggtcagtaccagtttactgtcattggtcggattcttttccactttgaaaatatcattcctgatgtcaaacttccgtctgtgctcttcggaataaatcctgccattgcacctgatagcctctttcttcgtcagaaggctctctatcatttctttggtgaagccgatggcagtgcatagcttttccattctcaacatttctttgagcatcgggaaccatttgaacgccttttcaagaatagcattcagtcgtgatatttccttgtctttggcttcaagctccagattgtgtattccttgcagattacgtatctgcttgccgtgctgttcctgcatgtgccgcatttgggctttcaggtcatcaattcccttatcccgtttggctatttcctgatgcaattcttcattggatagttccagtttcttcatttttccactgccgaaaagagaacccactccgctcactatgaccgtagcggcatcggtggctgcgcctttgagcttgtccgtgcgtatctccgatttcacctgacggagttcctgttcggcaaggtttatctgttcttctttgtgccgctttgctgcatccatgcgttgcagttcggctttctgcttctcaatgatgaagtcgttccgttccaaatgttttttgcctgttacagcctttgactgcccacgctccatcagcaggatatcagatgccaagttttgcatttcggtcatatcctcatcattgagtttgcggctcttgcctgtatcgtggttcatccagtcaaatacgatatgggcatggtaattcggtttgaaccacctttcgcctacttggaaactctccatgtcctccggtgcgggctgaccgttcagccaatgcccctcgtctttgtggaggaagatttggagcggtgtaatgccccatcgcctttggcactcttcgccaaacctacgcacatcctccagcgtggtgtcctgtctgattagcaatacaccctcacggatgggagaacatcccgccaccttgataatcttgccattcttccctttgcgctcacgctccttttcctgcatggcacggcctgtcttttctttgaccatgcgtttgatgttctcatagtgcgtctgcaattcgggactgccgaaatccggatttatccattgttcgttatcagccgtaagttcggacacgatgtagattttggacttgccgatgttgcgcatatactcggcagtcctccggttatgagcctcgcttgatgccacgttgcaaggcttgatatgtatgcttgattttgttgccatcttttcaatttttgattcggtaattactaattttgtttgctgctttccgctcataaccgcatggggttcttaggggtgcaacccataagcggagtttccaaagagagggtcactctttggtcggggttctcaggggtgaaacgccctgagtgggtcattagggcaaagccctaatcccctcgggagagcccacaactacgcaagcgaagcgtgtagttatagtgggctataaccggaagcctttcggtttcttggatagcgtgtcattcttctttctgacggattgcatttgctcatcagccatgcgcttctgcaaatactcgttcaggtctttgcatccgcagtagatttgtgaagcgtcccgtatatgccgggtgctgtcgtattccttgcggatttgccgcaaggcttccattcctgcacggtcattgtcaaaaaagcagtggatgcgctcatagctccccaacgggtagagtgccttggaaacattggcgacagagttcagcaccatgtaatcctgcctgtcgaaatcggggcattgcggacagctttcgagccgcagggtcagaaatgagagatagtccataaatccctcaaaaacgtaacaggtgtccttcggttctccttgctgccgtatgtgggtgatgtctttcggcgcgatacagcccttgaaatatcggttgcgtatctcatagccgcccaatatgttcggaaacgcaacggcgaagtaccgcttgccgttgtgcgtaaaccgtgcctccctgcattctcttttcgccagtgccggattgatacccctttcctgcaaataagcgagcaaggcaggggaagaaagcggcacgatttccaactgctggaaacttggctccgtaaaggactgcttgcgaaaagagaaagagacggggcgcacgtgcggtgcctgttcctctatgcgtttcagaaggtacggcacactgtccgttgcatagaggcgcgaagccagtgcgatgatgttgccgcccttgccgagtgcaaaatcataccattggttccgctcggtgttcaccttgaacgatgcttcggtttcctccctgaacggcgatttgtaccagagattggtgccctgctgctttaccgggctatatcccaagctgtgaagatactcttccagcctgatttgttttgctgtctgtatatccataaatgattgtctttatcggttatcgtttgtttttcttttcgccagtaccttttcatataggttactggctgtataaccacttcactttattgtcgtatatatagaatacggcttaaagtgaagcggtttgatgctaccctgcaaccacttcgctttatcctaatatatagaccccaagaataaagtgaagtgattgcgatgattgggctaatagtggaaatccggttcgtacctgtacttcctgccgttttcctgtactatcatccgcttgctctttaacactgtgatgagtttgaccagcttgttgtcgctcaacggaacgcctaccaaggcatacgattctttcagtgctttgcccagttccttatacccgtattcgtcctgcaacgagaatgcggcttccagtgctatccggtgctgttgctcggaaatgtccttgtaggcatcaaacctttcgccttggggtctgccgggtgctttggtttctgttaggtagtcctccatcagttcaggcaatgccctgtcattgatgcggaaggcaaacggctcgaagtccatcgcacggatgtgcatggcggaaaccttgctgatgtcactgttgctcttgtccttttccacaaggaggacggtctcagccttgttgttcagttccgtgccgatgtgtccccttgcgttctcatcgcccttgttctgatggagtatcgtgtggatatgtatctgcctttcatccgtccactgcatcagcttcgatatgatgcgtgtcgattcgccggggctgttgatgtcatataccatgtcacggatgccgtctattatcaccagaccaaggttctgcgtatggtagattgcctgttcgacaatccttatgcgctgtcccggcgtgtacttccgcaaggcaaggaattcaaagttctcgttgttcctgtcatcgggcagcccggccatgcgcatgatgcgttccatcacattcaggcagtgataggggctttgctccgtatccacgtaaagcactttccgtttggcttcgggcagttcagccgcataccggagtaccgtgccgttcttcaatgccgcagccacgatagccgacacattgaatgtcttcttgcttttggctttgccgatggatgcgctgaaatttcccaacgtaccgattacggaacctttcacactgagaatctcgggggctttctcgtacttttccgacaggctcagccgtgaggcttgccagaggattaccgcctgttcgtccgatatttcctggatgtctttcatattgtccatagcggttcctcccgttatttgcgtccgcctgttttcttccctgccagttcaagggcaagttccgcgtccacgataatcttgcgccctatctgggtgatggccttgtctatcttaccgcttttctttatgcggttggcagtgggcaggctgcacccgaacagcttggctatgccgagtatgccgtacacatacttcctgcttgtgtccgttacgggctgcggctgcgcttccggctgaccggatgcgtgcctgcttaatattatgaactcttcgcctgtcatctgccagacgggtttggataataactcttgtagattttgcatgattctactctttttgggttcaacaatcagccctacgcactggctgttatttcagttctcgaacgatgcaaaattaggtagggttatgagtggtaaggatggggacggtataatccgaatacgctatatcttattgaatatcaggaaataaaaataccactcaaaaattaatttgagtggtaaaagtggaactttcgtaaaatatcaggatatatcacggattatctgaatatatgttccatttccttggcgaatttctggttgctgtcactgggaaaatcggaaaccggctccttgtactttgacttgtagtagctgtcatcaatgcccagcaattccagtattccggttttccatttgtccctgtcctgtttggagagtttctcgcccatcagaaatatcagatagcatgcacggattttctctctcggtttgattttcagtttgcagttgcagggttgcaggttcatattggcataaaaatccggtgcggaaatttcctcgaactgttctccaacacatgcttcatgaatgagagaaagtaatttcgtgctgaagtattcgtgctgttcccctgtcgtttcctgctggctgacgggtttgcccggctcgtcctgtcgtttcccgtcaggaacgtatttcttcagtatatccagaaaaaggcagctttggcggtatatgtccgcacaacggttcttcatatattggaacgcctctttccttgctgccttttgctggtcatagagttcgttcagtatggctttttccctgtcatattcagccttacagcgttcatattctttctccgcctgcttttcctcttcggcggtatgttccctgtagccaatggaatcatacctgttgttggcttcattcagcggcttgctcaggcttcttgtgacatccagttgggctttaatttcaaaggaatacctttccatatgttgataacaggcacgttctatcgcactgtcacttatggggtgcgtttcataagcctgtatgctcttttctatttcggttttcaggctgttgagtatcaaggtgtattgttctttttgcctgtcaagcaccagttcaaggatggcggcttcaaaagattttgtgtcactatactgctgacagaaatccgaaatgaatttctgcctgtcaaaagagaaaatactattgtctatatagtccctgtatattctgttgagttctccgtaccgggggattatcgtctgtatcttgtctgtcataggtgtcttacttttgtttgctcttttcattgtcaagaagcatcgtcagttcttcttccacctgttctatgctcggcaacgcagatttcagattttcgggtactgccttgctgagttggtaatcgctgataccgataggctggtcatagcctgtcagcgcatactgcgctacaatctcatctttgcccttgcatagcagcagcccgatggtcttgttgtcgttctctcccctcagtttgtcgtccaccacattgatgtagaaattcagttgtccggcgtattccggtttgaacggggtggccttcagttccacgaccacgtatgcatggagcttgatgttgtacagaatcaggtcggcatagaaatcgctgtcgccaatctggaaatgcttctgtcttgcgacaaaggcgaatccgttgcccatctccagcagataacgggtaacgtgctttaccagttgttcctctatgtccctttcgtccgcacgttctttggctcccgccaagtcaaagatatacgggtctttcaacaggtagttggcaaggtcgctttggggtgcaggaagcgtggcggtaaaattgttgactttgcgactgttgatttgcctttcgtacaatttactttcaatctgcattttcaagacattgctgctccagcccatttccacagattgcttcatataccagtattccacacccaacggaagcgaactgttgagcataatcacatggcttgcccaattgattcttgccacaggtgatgcaaggaacagtttttccatgtcctcaatcggcatccagtaaacggcggctactgtccgggctacgtcctgaatttgtgcaagaggttcttgcataattgcaactcccttgttgtctgaggattgtatttgcgcaagaggttcttgcgtaaatggcacattgttcaggctttggatttcatccgtgattttctgcacacttggggtaatcaatttcgcatcggtttcgatgaaactccgtaatacggtcaatggatatgagcgtgcgaactggcacatataagccaagttcctgaccgaatatcctttcttttcgggataattgaaccgtatcgcctgcgccagtttcttgatgaccttgccgccccagccttgtctgttctggtggtacaatatgtaattgcccatcttccagtagtggaacagcatctgtgcattggctgcactgatgagccggacttgcgcctgctctatttccgagccgatggcattgacaaaagcctcgaaactctttttctctatgttgttatcgttgttgctcattgttgtatgtattgaaagtcacaaaggtaagccaagttacaggcttcccatgaaacttgctgattgtttttacagttggttgaatttattcattgcattggctttcacatcgtcggcgatgtcaatgtaaggtttcattgctttgtagtcgctgtgtcccgtccatttcataaccacctgagccggaatgccgagagccaaggcattacagatgaaagtccttcttccggcatgggtgcccaacaatgcgtatttgggtgtaatggtgtctatccgcttactccctttataataggtctcgcttactggctcgttgatttcggcaagctcacccaactccttcaaataatcgttcattttctggttgctgatgaccgggagagccttatgcccctcaaactccacatccttatatttatccagtattgccttgctgtggttgttcagctcgatgataagcctttctgcggtctttacggtggtgatttctatatatccatccctgatgtcgcttttcttcaggttatgcacatccgaataccggagtccggtgaagcagcagaacaaaaagacatccctcacccgttccagatattgcttcgtttcggatatctgatagtttttgagttggttcagttcttcccacgtaaggaatatcacctttttcggggtgctccgcaatttgggattgaaatcttcataggcattgttcatgcaataccccttcttggtacaccagcgcagaaaccatttcaggtaagcgacctgtttcatgatggatgtgttccgcatgtcttctgtgtctttcaggaaattcacatactttgtcagcttgggttcgtccagcgattcaaaagtcagtcccttgtcaaacttttcaaggtgcttccttactgcggcaaacttctcataggtggcatctgaccagccgttttgcgtgccgcattccttgatgaattcgtcaaacacctccaaaggaagaaacatcaccggggcttgttcctcctcttcctttttcccgtcatgcaatctgttgaatgcatcctttacctgctcggtagtcggcatgaatccctgcacctcgaactccttgaatatgttctgtatttcggtatagtatctcagcaagtccgcattgatttccgatgcgctttgcttcagcttgttggtgcatccattctttacccgctgcttgtctgcatcccatttggcgacatcaatgcggtagcccgttgtgaactcgatgcgatggctggcaaaaactacacgcatacggatagggacattctccacgattggcactccgttcttcttccggctttccaatgaaaagatgatgtttcgtttgatattcataattgggtgcatttgaaattcaacacccaaatatacacccaataattgaaatggcaaaaggtatttaatgatatttagtaatatagtaggtttgtaataacttgattattatcagtatattgcaatcttatgaaatttcttgattgtgtaagttaaagtcccgtccgcaccgcttcttaagaaagcgaaacaaagaaaaagctctgtaattcaatgattacagagttttttttatttcacttttctactttgtacacagttggctatctagccggaaatcatattctcgaagctaacttcaaggttttcaaatcatagattaagatttcatccttatctgttttgtcatacttgttattattgtttgtatcataataacctgcgacgacaagtttacctgtttgtgtattgacagtcccagtacggacaaaaatttatcttccgttaattgagtcatttcttttccgagcgtatcgcactcctccataaggtattgtaccttccaattcatttttcctgaatggaaaagttatagtttttacttcacgcccttcatcattgctctttgaatgataaaaagtttcctattgtaaactgaataatcatattttaattgtattattcgatattttaccacaattactactacaaaagtcaattaaatatcacacctttgtactcactaaaaattagaatcatatatgaaagaagtaatatttgtaattttagaagggttcgccgactgggaaggcgcatatatagctacctgtttgaatcagggagtcaagcccggaaatcctattagttataaagtgaaaaccctatcaataactcaagaacccgtaagttcaataggcggattcagagtgctgcctgattatgggctaaaagatatggcggaagattatgcggggctggtgttaattggcggtatgaactggttctcacctgaagctgaattaatagttccacttgtagaaaaagctattaaagaaaagaaattagttgccggaatatgtaatgcttctgtttttctgggtatgcacggtttccttaatgaggtaaagcataccagcaatacgctcaattatctaaaacagtatgctggggataaatatacaggcgattcgaactatatcaatgaacaagctgtaagagacgagaatattgtaactgccaacggaaccgggcaattggaattttgcaaagaaatattatatgcattagaagctgatactgccgatgcgatagaggaaagttatctgttttataaaaacggattctgtccgggagcataaaatgaatgaaagaatgaccattcttaaaaaaggaatatttaagcaatcagaaagagagacaatagcataacgatttaagaaaaatagaaaaaagcccggcatctgtcgggagaaagttctttattattatcatttgggacatatatcatccaaatagcagctattttccattattcattcaccattcaacataaaatattaagataaccgttctttttattattcctatcctttctaacagttatgccaaactagagaaaaaccaccctcaaaaagaccagtttcagcttcctcaccgatgacaaacaagttcctcggtgaggaagctagcgacgcacaccgaggaacaccccgctcctcaccgaggaacgaacgctttgccaacaagaaaagatgcattccgtatgtagttttatgcgaaatagacctgtatttccgcatattattgccctattttatgccgtttattcactggttcattgtttttaaagttgctattcttttatacaatcttaaaaatagcacattgagactataaaagcgctgtctcttagtatctcttatatactatgagttttattctacgataaagctctccgatttgaaattactataaaacctaccggaagttgccgtaaatttcaatacacaatagtcgggatctgtcactccttccgggtaatacatggtatcaccctcctgccaaatcatttctttgctggcactgtctgtcaatacttccattgtaccccgcagcatcgcacctctaaaaaatcttgtatcacaaaagtaaatacacgcatgattgttttcccggtattgcgccacacgcatggatgaagtattcgttgtcagataaatcgtttttatcccttccctttttcttggctgcaacattgccttgatattaggaaatccctccctgtctatagaaccgataaaagctgttttcaacttatcaatcatgttccctactgttttttctgcgtctctcatcatttcattttttattgttagttattatctgatgcgaaagtagagaaatagaagaggaacggcgtaataaaaagaaaggggaaaatagtactttttacggtttatgtgttttccgataaagtaatggagtttctcccgtatgttgccggaagctgcgaataaaataggagaccgttgaaaagcagagttcaaaagcaatatccgatatggggacatttgtataaacgagcagtcttttagcctcatccatcactttattctgaatatattgtttggcactaaaccccattgtcgaggttaccatctcattcaaatagttagaagtaatgcagagtttatccgcataatactgaaccgagtgttgctctttcgaatggatatttaccaaattcatgaatttacttacatggttattagacgcttctctgctcctgccctcctctatcgaagtcattttaagataagcccggtccaataacatcaggacttcataaagcaacgctctcaatacatgcacatcgttttgctgatacgagtcgatctccatctttatatgatgcaaaatttggagtatacgggcataaagctcatctggcaaatgcagtcttgatgaaaagctttccagctgaaaaaacgaaagatgctgtacaaacaaagaatctttaaagagggaagacaagaactcttcctcgaaaatcagcgcataaccattgatgatatgacgcgtatcccagttccggatttctcccggtttagagaatagaacgtcacatggggttacttcataggtttggttatcgacagaaaacgtccctttaccttctgttataaaagtaacatcataataattcaacgtgtgaatagcactttcagccaagaacttcttcacatatttcagttctaccacatcgaccaaaagttcgcttccatacttattcttataaaaagtatatcgaggtattgagtttttcatttggaatacaaaaataatattccttaccaaataatccaaagacttttcaaactcaattttgaatagtcaatgaaccatctgataaggaatacatagaaaaatagatgtccaggttatatttcctatttagaacttccagccatatatcccaaactggttacatcggcacccagataatgagtaatatacttcaaaggtaccctgtacaggatatccgggatttctgccaataaagaaagatacctctctcttaccgtcagtttccgaacgttcatattctcttcttctttaaaatagaactgatattccatcagttgacgaaccaagttggcaaacgaaatagatgttgcgcacaactcttcaatctcctcttcgctgatgtaataagcagcacatttcgtcagcgcctttacagcatattgactggagttatagcacaatacagcatccccttcagataaaaaccggatggttctatcctctccttcatgagtcgtgtatgtatgcagaatgccggaaacaataatatacaagctctgctcgggcattgtggcagatgcaatcgtttctcctttatccagatacaccatttccatacgagccaacagctctttcacttctttttcatcaacctgatactcaaaacagagtttcttcaaataagcttccatacaaaatagattttagttaattatatgtcacctaaaaacacctaattcgacatagcaggcatcaatgtgcctctcaagtataatttcctttgggtatatcgcaaataccagatacaaatcaataatgaaaccaccgttgaaatgggtggagcaaatcccatgataaacagcgacgagctatccatctggctgaaccagtatgacaatggtatacggaacaggaaagtggctatcagactgtgaatcatcgggaataacgagttcccttgtccgctgaaataagaattgatgcagaacacaaaactgactacgatacagtcgatgctatatccccgcaggtactctgctgccattgccaccacagcggcatctttcgtaaagaaagcggtaagagtctccggcaggaattgcgaatacacgcaaaccgacacaccgaaaacaagagcaatccctattccggaagcaagacatttattcattctcttgataagtcccgccccgtaattttgtgcagtcatggttgccacagccgatgatatagccatcggaggcagcatggcaaacactatgattttctcaacaacacctaaagaagcagacgcaatgactcccatctgattcacaatgacagtgattatcagaaatgaaacattgattaaagcatcttgcaaagcaataggcgctcccaataccatgatctttttagacagattccggttcaaacggatatccttccgtgagaaatcaaagtggaatccatgccggtataagaaccaaagcgctattccaaagctgacgccttgcgcggttacagtagcaatagccgctcctgtagctccccaatggaaatagccgaccagtataaaatcgagcattatgttgattacacatgccaagcctacaaaataaagcggtgtctttgaatcacccaatccacgcaggataccacatacaacattataccctattatgaacaaaataccagccgaacataccagaatatagtttttagtatcagccatcgcttccgcaggcgtgtgcatcagttcggttatctgcccatgaaatgccaccatgactaaggtcagcaagactcctacaattgaaaatagccacacagaagaaccgattgtaaaagctactttccgatcatcttttgctccgatggcgatagcaatcaatacagttgtgcctgtcgtaatgccaaggataatacctgtaatcgtctgcatcacctgactgccgatagccacagccgccacacttgccgaatcatcatattgccccacaacaaacaagtcggctccaccataaagcgcctgaagcacattggcaataagaaaaggcactgcaaattgcagcaataccttcggaacacttccttgtgtcaaatttaactctttcatagtttctccgctactttacctcttatcttaaattgttacaataaaaaatagtgccggacaagcgaatgatttacaccattcatcttatccagcactataattatctattatagcaccctccgatgaggatttttatgcctgtccctattttcgggctgcaaatatgcgctttgtttttataactaccaaattataactgatttttatttttgaatggtacaatcaggtatcaatgtgaagcttttattgcagccgcttttctactcccggaagcggaagaaagcagccaatcgatccggattcagcgtgtagcgggcacgttcttttaaaagtggttcggcgttcatcactgcacaagaatgaaatactactgacatcatctcccaatccttcagtgaatttccgacaaccaatacttggtcaaggggaaaagctaaagccttgcatatatgaagcactcctttccgtttatcaacttccttatggataaccgtaataagaggtggtttataaaacacctgataaggtttctcttttaagcgagaaagaatatttattctctcttccttatcataaaccagcatgctgtacttataaacttggccttcatagctatgcgccgttatctttgcggattcttcgtttatgtccagtagtaattcaaccggcatacaccggctctgcccgccatataccagtaatccaccgtcggcaaacacccctccttcaaacaggctgaaaagagtcttgcctaactttctccgtgcctgttgcatagataaagaagtagcaagatataagggaacaaattgcgctatgtaccgcaaagcatgggcataactttccgaaacccttccctgtgcatcggtaagtgttccatccacatcaaaaaacacggaagtaatgaaaggcttatccgggatccgccaaaatgcacctgctcccattattcgatgcaaaggatgattagtcaaattactgaaagcaatgtaacaatcacagaccttccgccgacaaggaagcaaggggtccaagatctgattctgataaagatttcctatcttcacctgacttcggggacaagcaaagatatctcctttccaatcaataaaacaactacttctccctcccgaacagatagtccattgagccgaagcgttttttaaatcatactcaaaaaggttatccagttgcgtaaaaaaacgaatatcttctacgctcaacggagacttcaaaccttgcatagcattaataaacaaataaatatccggcaaaagagcatttcgcaaatcgctaagtacactttttgccatcggattgcctaccgctccggcacagacctgtattcctgcattataaagcgtatgaagtcgccggacaaaactttctactgaagtcatttccggatgaaagctggcccaaatctttatcttacttatcaatgccggtgtagccggaaattcgtccagccattcatcggccgaaaaagaaagattagtctgacaggaaattccggccacttgtggcaacgccgctaaatgaatgatccctttccgataataacgatgtatcaatgcttcaccgtaaggaataataaataactgcaacggtccccctttccattgttcaatagccgtaataaaacggttccacgcctgttcatcctgcgtagtggctgtcagatgtgactttttgccgaaaggacagtaagagcaggtataattgcagctattcaatttaccgcgataatagatacgcttgatggaaagtaaatccccctcgtttttcatttccatttcgttcaataagaataagtttccatcagccctcttatttcaggggtaatgaataactgaccaatataatcagaatatcccattccttcggaagtaagacaaatgcgatcatctgtattttctatccattgccgttctgccagttgccggaataatggaatatcatccggtgattcgccaaaacgacgctcatattcggctttatcaagccccatataatacatcagatttttaatgatgaaacgttgcctccgttctttttgagagagaataaatccattgcgagctactgtaaaatcagtagtgtccatatagtcatctatctcttgagcaatgcagtgttgagaaacagtataccgggtggcataatgcaaatgacccaagtaactacgtccaccggaaccacacgaaagcatcacttcatctccacaggaaatttccgcatcagtagacggatgatgaataaaacgccgcatcgaagtttgtagaaagcctctgtctttcaagagatcacgggcggcacaatacatccggaaacagacatcatcagattcccgctccgtgatagctgttccctgtcgcacatataacggatagataaagagttcgttaggctgaaacagaagagcctgctctaaagaatagagaaaactatccactgtttgtcctttgattccgtaaatcaagtcgatattaaaaaaaggaaattccatcttccggatagtttccaacgcctgattgatcgtgtcttgccggggacgtcttttcaaagcggttaactcttcgttgagaaaactttgtataccgatacttatacgagccactccggcttgtttcaaccatgtcaaacgggcaggatcagcatactccggtgatgtttctatggaagtaaaagcatgtgagggatgcactccgaacagggcagccgtctccaataagtattccagttgggaaacggtgagaagcaacggtgtacctcctccaatggcgaaactgtcaaagatcagtccggtggtgagaggtgacaattgttgtgcctgcttatgaagggtttccaaataagttgcgatataatccgcacgattggtttgtagagaaaacaggttacaatatccacatttatgactacaaaaaggaatatgaaaatagagtgatgccttctgcccttccacctgttccaggtaaggaagcagcgaaaccggagatggaaaaggacgataggcagttttatgtggatagctatacatatagtctacatatcgtggtagcggttgattcattgtttcgttaaaataaagtgtttgtaagggactgtataaaccgtttcgtgagatatgcaatggtattcatacccatcttcaccataacaagtgccatgatcggaaagagcaatcaccagcgtattgctccgtttctgaaaagcctgaaacaaacgaggtaactgactgtcaatatattgcagggcagccgcatgtgattctttatcatctttcattttaccctccacataatgacagttcggataatggatagcagaaaaattgatatacataaagatccgtttgtcgtccggataattttctagttttttcaatgcaaaatcaatctgtttttcagtactatcgggtgctgtgcatccaaaggtaggcagccaataacttttagtaaagtaaccggggaatacacgccccagctcattacgcttgctaaagaagtttacgccacctatacaaatcgtttcatagcctgtatgggcaagactctgcacaaaagtcgcttctgtaaatggataacttcctttgggcggaatacgtcctgtacccgcttgcacggggaaaaacaaccagttacggctacgcaacgaatgaggttctgccggagaaggcagaaatccggcaaagatggcaaaatgagacgggtaagtgaaatttcccggagcatgtcttttctcccattctcctccatggctgttcagtacaggcgttcttccggccgcttcttcctctttgctgacatcataccgcaaggtgtcaaagcaaagcatcaatatatcatgagtacccaccacctgattcatatccagatccggatgacgggtctgttcgccagccggcagttcatctatttgcatggttatatttcttttttatgttttttatttgttgagtataaatagaattatgagcaaacatatcctgataaacatggtctccttgtccgttgacttctattatataaggaatatccgtccctctttctatcaatacatctactcctgcataacgcaaatccaaggattgcacagcttcctgacattgaaaatagatttgttgccgtacctcttcggatagagacaattcattccaccaatgcgccttgttgttcaggtgtaaattcgttatgcttcctttgctgcatctcacaacgatataatctatttcagactcccggcacactacccgaaggtcataattttctccttgcaattgtgctttaggaatccattcctccaggatagcttctgtttgtatcacagcttctgccaacgggattatctctttttccacgctcaaacgattgattcgtttggtattatgaatcactccgtccacttgccgcagcgtagtatagactacccacttgttccggttgggctgataacgaatcgccataatgcctcccgcacccgaaccataacggggtttcaaaaagcatcctctaccgcaatcggcaagaagctgccgtaactcatcgaaggattgtggagacggcaacatcggagtcactttcagccctttgtccatcaggacttcttttgtttcctttttatcaagagcacgcaacaaagcatcaggagtatttaaaaagcacacatcatcaggcaggctcatctcgctcaaacgttgcaatgtctccttatatgcctgattcaacagcgcatatttcaggagatcagtttcatcacttacacagggttccagtttgataactgcctgccgcaatagcggcaagcagttaaaaagttcctcataagtcataaaacaaacttctgtctgcaggtgcttacctgcttcaacaaagtattctatacgtttggataaagagttgctgacaacgattatctgcatctcctattctgtaaccatcgggtaataccacaattcaccatcatattcatccgcctcttcggtttcggcaatgtctattttcataggaaggttctgcaactgtttcttcatgtccttactcaaataattatagcgcatattgataaacttcaagtgaacgattttatccatattatccagcaacaactgtgcaccttcatctttcagagtaccagccgaaatatccatggtttcaagttgaggaagaatatccgattccaggaacatttctacaatactatcctgttcttcagagttaacaagccccagataagtcagcttcgggaaacgctctttggagaaaagcggacggaagatctcaatatcaccttcaaatccgtaatcttccacaccaacatatagaaccagtttttccagattgggaaaatcagaagcaagaatgtcctctaccacttcagtaggcagaccaccactgattatttccagcgaccgcaactccggacgtgaagttcttcccaagcgcagattgtttgttccttttattttcagatccttcaatttaggcatactatcgagcagcggactaaggtcggcttgttcaatccatgagatctcctgttcttcctgttcaatatccccccagaacaggccttctatctgcgcaaacttgtccttattttcaatgagaccttgtaacaaagccgaacagtcatcaccttcataatcccaacagccaatcgttatttgcttatattcagagagatgcttgtctttcaatatcttatccaaaagcttcacatcgttttcatactcatcataactcaatgtatatttcttagcttccactttcatttcacgtgctgtttcttcggcagtttccacataacctttctttgtcttctctgcaatcagtttgttggcagccttctcagcctcttcagtagttgcgtagtttttcacttgtgtttgtccggcagtccccagcttaccataatttacagtaacatctgtcccgactacctctatactccagaatttctgcgatttaaaatcttgaaaaacgaatactctcttcataatacagtttttaatggttgatatttgcacactcaacacagaacgcgcatgaacaatacttgcaaaaatagctattttatgtaatgtacaaagaaatctgtttactaatctttcaggatattcaaaaattagccgcttatctataaaaccagtacatacaacaaaggctgccttttgggcagccttcattattctatttatgtaatctatctgtttaatcttcaatcgtacatatacttacacggttccaatccggttcggtaaacatgtcgcctacgccctgaccttcggcagtgatgcgggatgcactaatcttgtatttattaacaaggatagtttttacagcctctgcacgtgcagcagcgattcttgcgttgacctccacactaccttccggagaagcgtatcctttaataactacttttgagtcaggatatttcttcatgtatgaagctacacgttccacgttaggaagttgggaagcgtcaaccgatgatttaccttgtctgaaagtaatgatagattcgggcacacgggcggttttcactacagtctctaccggaacaacctttgtacggcaggcttcaagttcttcttgcagtccgttgatgcgctggttggcgttgctgatctgaccgtctttgttgttcacttccgaacgaagcgcattgatggaagagttcaatccgtcaatttcagcttggttgtacactctcacttttgcaaaatgatgtgttccgttacttgtcttaaagtgatatgtcaatccggctgtcaattcgaaacctgcgttattggcattgaaacggctctttgtttcggggtaagtgccttgcatatcatatacaatggcaggtttgatacccaatgtccatgccttactttcacccaagttgaagttgaaattcaatcccaaacgggtagaccaagtgttctgatctccatcaccattcacataataatgtaaccagcccattcctgcaacggcttccacttcaaacaaacggggttcgcctttgtaacctgcaaacaggttcatcaggttgactttacccaatacgctgacgtcggaagcatcgaaagatgttttactcggagtagtattaatgtatcccattccttggaatcccaaaccgaagataggagttaattgcttggaaactcccactccaaaagcaggacgcatacttttaaagaaagcactgtgagtaaggggagtgattgcaccggcattgacttccacagaccaattgtctgttacttttgtaccttctacaactgattgggcatttgctgtaacgccacccaatatcaaggctaataaaataatcgattttctcataatcataagttttaaaatgtaatgttttatctgctaaatcattagaaatgttttatttgtccatgtctaactttctagttcattttttaattcgttattcactttaaacaacatatcatatcaaaaattagttcgcaagcctggtagccaattaacatctattgtgttttcgagcaatctaaaatatgaaaaatagaacatcaaccgggagttgtcaaaggaaacattaaaatcaacgtctatatcgcatagggaacggcgtaatggaagatataagctatcgtttccttcctcatccttccaaaaagatttctaaaaaaaacgctcaaacggatgctgtttttaccgtttgggcgttactttttgggtttgaaattatatactatacttttattatcaattccctactatccttcttcctctactaaccatcgactcaaattgcgttcttccttactgaactctgcacctattttcactatacggcaaccattagtagtataaggtatgagatagccgcgattatcaatctgtgccaatgcttcttctgcggtaccgtttagcttaaattcgaagacataaacagcatttgctgttttcaccacagcgtcagcacgtcccagggcactttgcacttcggcgttaataaactgccccagtagtttaaaaacaagatagaataccacttgatagtgacgctctgtcttatcattcagttcgtaggggaaatcggcaaagaacgcacgaaggcgggtgaggaaagcctcaacatctcctgcccttagttcctttacaaactgtccgatatagaagggggctttcgattcatccaacgaggtataaaacggagtgataaaattaagaaagccatacttcacttcatcattggggtaacccagcttgtagagacgcagttctgtatcatatcctttaatggtcagatagccgctttgataaatcatcggcacagggttgtttacgtcagcacggtcgtcggtaagagaggcagcagttacttccaatccgtccagttcacgcaaatcataatgggtcttcttcagcatttcggctaggaaagtaggtgttccgctggcaaaccagtaattctcaaacatcccgctcctaagcacattcagtatactgaacgggttgtacataccttccttacggacatagttgaaatgatatccgtcatacatacgagtaaggtatgccatacaatctttttttgtcaaaccgttcctttctgccaaccgttccagttccgggacgaaattggcttcaatttccgggcgggtcataccacaaagagcattgtattgcgggtcgaagctgatatcgatcagttggttgagagtgctgaatatacccatttgagcaaatttggtcactccggtgataaagacgaagcgcaaccaggggtctgctgatttcagtacagtataaaaagcggtgagcatttcgcggaacttgtcttgtaattccggattatgcatggagcgaagcagcggtttgtcgtactcgtcaataagaacaactacgccacgacctgtttgtcgataagcttctttaatgacttgcatgaaacgaccggaataactcaaaccttcctcactggttccatagactttttcccaactacgaagctgcaattcaagtccgtttctcaatccttctatttcagagtaatcctcggcattaaggtcaagatgcagtacagcgtgttcgttccattctgtttcgagctgctcaatggcaagtccttcaaaaagctctttctttccacagaaatacgcttccagtgtagaaagcagcagacttttgccaaaacgacgcggacggctaaggaaatacggattgcccgttgaggcaagttcgtagacaaatgctgttttgtcaacatacaaatagccgtcgcgacgaagtctctcaaaactttgtatcccgataggcagattgcgccgaggccctttcaaacggtccatgatatccataacttcttctctttataaatgaaacctttgcaaagataacaaatcttgcagtgaatcgatcatcaaatatgaggttttattatctcgtcctgcaaagtttccgacagataaaaacaggtattcaaagtgcatttcaaaacaaagctgatagataacatagagtaacaataacaagaatagtggagaaactatattttataaaattaaattacccagtcaatatatcaattattattatcacaaccacacaagtttctatcctttagagaaaggttatacaaaaaagataacaacctaccacataaacataaagagcgttattaataaatactgtgaccgtttattataaacgtcccccctgtttattataaactttaaaacctgaatttgcaaaaatatattcaataataggttacaaaaaaggctgcgaactctgtaaagttcgcagcctttgggctatatctgttgccttatcccctagtataagctaagggaatgagctaagttcgttgtaatattatactattttccatccatttcatatccatattccgtctgttttttcattcagtattcattcgtttcatactttcccggactacaaatatataacattaaaaagcgtttgtcaagtcccggatagattttaatcgttatctttggggatgcatcaatgtctttattacttttccggaatcacttcgttcagacaggctatggcattgagtgtgcgcggataaccaataaatggcaagagttgcgttacgactgccagcaacgtatctttattattccctacgttggcatttccctgtatgtgactttttacctgcgattcacagccgcctaaagaaacaagtatcgagaatgtaatcagttcgcgggtctttacattcagtccgctacgtgtctgatagtcgccgaaacagttggcggagaggtaacgttggatgtgcttctgattgtcgggagcgttcttatgcatctgttctatccgttcaccaaatatggatttctgcaattccagtcccttattgaaacgtgtttcggatgatacaaccgattgtccttccaaaggaagacgcacgccacgggcgagcaatatatcattggtgataccgataaaatctctgaccttagccatgcccgcataggctactgactggtaaaggatttcttttatttctatcggagcaatgccttcattaagtgcgctttcgagtgtgatgcggtattcggcctgcgcttgtgaagcaatattggatgccaatgttaccataagacgggttttaatgtccagtgcaccgtattcttgcacttcttttgtaaaattactaaatatatcgtccaattcaggatcggtagcttgcagtccgattgctacgttacctttcgttgcttcggcatactgttggtcatccactcgttccaaccatgtattctggttggtctgcggattgcatccgatagccagatgtgagaaccaactatcgggagcggcgccatgccaatgttcgatgttcggagcaatttcaaccacatcaccgggaagtaaacggcgcgccgctttaccacgttcctgataatatcccacaccgccgacggcaatcaggagttgtccacccgtatggctgtgccaattattccggcagccaggctcaaaagtaacgttggacatgggtacattcaagtctttgttaccagtcagcggtgccagccaagatctacccgtgaaatattgttcgaatcctgtattcgcttttcctaccggaaatgcgctgatgttttgaggtacttcttcttttttcatattctgtgcatttatagattgcatcgggatttgcatcattccgatggctgttacaataataaaaaacaattttctcatataactacgtatggtttattatttatgaactctctgataatgcaaagttagctattctgttccaactctttatgatacaaattacggatatagaaaccaatattactgattcaatttacttaatcttcagcccgggaatgagtggagtggtatctaccagttcgagcgactgcaccatatcaagcgtttcttttttatatttctgaaaatgaggcgtagcaatatggcttttataagctgcttcatcaacataaatttcaagaattgtcacatggtggggacgttctttctccgctacggcatagagtaccagcacacctggttctaatcgcattgaggcttcgatttcttccttcagataagcattatattcttccagtcgtgccgaatcgactgttatgcgagacaaccgtactttattattttcggtggcaagccgctcaaccggtttaatgatgctggccgaaatagcggcagcaaacaatagaaaagcaatcagtaactttttcatcttgataacttatgatagttcgaatttcagtattaaattaccgataacaaagttactgggaatcatccaccccgaatgtagacgatttacggatatttataccccaatcatggattttgaagatggagaactaattttatggataaaagaattatatttgtaacctactaaaagcagacaacgctatggaagagaattataaagacgaaatgattgtaatagataacgtgaatcgttataacgaaatattcggacttgaaaccaaacatccgttggtcagcatcatcgatctcaccaagtccaccacatggcctacacgcgcatggtttcgctatgaagtgtatgcgctattcttgaagaatgtaaaatgcggtgatattaaatacggtcgtcaatattatgactatcaagacggaaccattgtctgttttggccccgggcaaattactgatttggaattaatccaaaacattcagcccaatgcgcacggcctcctattccatcccgacctcatacgaggcactagcctcggacaagaaataaaaaactactcattcttctcttacgaaaccaatgaagcactccatctttctgaagaggagcgacagatagtaatggattgcctgcaaaaaatagcaatcgagctaaaccatgctatcgacagacacagtcgccgcctgatctgtaccaatatcagattgctgcttgattattgtatgcgcttttacgaacggcagtttgaaacccgaaacaaagttaacaatgatattatcgtccgcttcgaacatctgctcaatgaatattttgaaggagatgctccgcaacatttaggattgccatcggtcaaatactttgccgacaaagtatttctttctcccaactactttggcgatatgattcgtaagcaaactggtaaaaccgtctccgaatatattcaggataaaatgattgaactggcaaaagaacaactcttgtcttcagataaaacaacgagtcagattgcctacgaaatcggattccagtatccacaacatcttagccgaatgtttaaacgaattgtcgggatgactcctaataaattccgcacgcaaacctgacatcttaaatacagagatatagcgtcattattagatcaccacattcctccctaatactccccgttcacgtattttttacgttatgaatgggaagtgcttaacatagcattacaagtgacttttttactgacgagataatacgaatattaaagaagcgtcaatcctctatctgtttaaggattctacacggattgccaaccgccagcacattggccggaatagactttgtgacaacgctccctgccccaatagttgtattatcgccaatagttactcccggaagaatgatgcatcctccaccaatccacacattattgccaataatcaccggagctgtctgtgacttccaaaaagtactgttttcagaggttctttccgatgcctttgtagaatgaaaaacagtataaatatgtactcccggcccaatccccgaattatcaccgataacaatcttgttacaatcaagaaaaacgcaattcatattaatctctacattcttcccgatataaatattctcaccatagtccacaaagaaaggagcactaatccagacattatccccccttgaaccgattaattcatctaataaatcagaaattttacctgcatcagtagtgagagtattattatactcctgttgaagctgctttgctttatgccatctggtcagtaactcattatcagcacaatcataaacttctcccgccaacattttttctttttctgttttcatttctcaaattattggtttattcatcctgatacaaatataaggaattatattatcgaaatgatataagatgtacatcgttttctatttattgcgctttacgcttccgacctatcaacatcactcccaacagaataaccagcaaaccggaaacctgaataaaagtaacctgttcgtttcctaaaaagactcctaaaagaacagcaataaaaggattgacataagcatgtgtccctacctccgcagccggacgcactttcaacagccaaacgtatgccgaatatgccagtaaagaaccgaaagagactaaataaagcagggagagccagcttgtaaccgagacttcacgcaaatcggcctcccgaacatctccattgataacagcacaaagccaaaacattccactggcaaaaagcatctgccaggcagaaccggcaaaagcattcactttttcttcacgagaagaacgatatttggcatatagcgttcccaaagcccaggatatgcacccgaaaataaggagcagaataccacgctcactatacgaatgtaaccatctgacattgagttgctctgcataaagcatcactacccctccgaaaccaatcaaacctcccattatagtaagtggattacggaaattagtacgccacatcgggacatccaacagcaaaatccaaagggctgtggaagaagcgataatggctacaaggctactggtcagataacgttgcgccaacataacgacagccatatctacaaacaacaatacaatgccactaacggcggaacgttttaccaagcttttctttataatttgttctccccgcaaataacagattcccagaagtataatcccggcagccgtaaaccggagcgctccgagaaggaaaggcgaaaagtctttcaaggccacaccgataaaaaaataggtggagccccagactacataaatgagaaaataggcaacaacaatacctaccgtattccctttcgaacaattcagactttccatattacttcttttcattcgtatttacggggagtgagaagggggatttctcaataaactgacaattattttattatttcaaagcccgcttcaatctgtttaatccatctatcaaccgctgtcgcggacaggcaatattgatacggataaatccttcaccagcctctccatacaggctgccttcgttcacccaaagtttttctttcttcaacaagtctttgactatttccgctgacgcctgatgcagaaccgaacaatctacccaaactaaatacgtaccttccaacatcattacaggaaactccggaagataggtctcgaaataaccttttaaatagatgtaattcgcaaacaaatagattttaagttcttccagccattcttcaccctcattataagcagctatcaacgcctccactccaaaaggattcacatcacagacttcatttatattaatcgctttatctatccgcctccgtacatctgcatctgcggaaatgatattggctatctgaagtcctgccaaattaaaggctttgctaggcgaaacaaaagtgaccgagttcagtaggaattcttctgatatagaagcaaaaggagtatattcatgccccagaaataccaattcacaatgaatttcatccgcaaccacaaacacattatttcgaagacaaatctcacctatccgccttaactcttgcttgctccacactcttccggcaggattgtgcggattgcataacaacagaagttttaccttcgggtctgaagctttccgctccaaatcatcaaagtcaatctgatagcccctgtttctatataccaaaggattggcaatcatctcgcatccgttattacggatagaggagaaaaaacagttatatacaggtgtctgcaccattactttatctccgggcagcgttaatgctttaatcacagcagatattgccggcacaacaccggtggtgtaaataatccactctttttccatccgccaggcatgccgttgagcaaaccaatttagaactgcctcgtagtatgcatcaggtacacgtacataaccgaaaatcccatgttccacccgtttcttcaatgcctccacgacagggggagccgtacggaaatccatatcagctacccacatcggcaatacatccgcatcttcagccgaatcccatttataagaattcgttcctctgcgtggaataatttcatcgaaattatatttcatatttcaattaaaacaggttagatcgtcccaaagtttcaattcacaatttgctggtgatttaatattttcgtccaaaatgattgctccgaaactttcggcaacaatacttcccgtacgaggattttttacgcaatgaacgggacttttaatcgttgccttcacactactgtgttcaaaagcaaggtcagcatcttccgccatcgtacaattttccatcaccagatcatgtgcgtagcaaagcggttgagtccccgaaatcctgcaatttaccagacgtaagtttttagaatgccagtccagatattctccgttcagctcggaatcatagactgttacattttccgtattccagaaagcatctttggaattgataactgcattatggatttctacattcttgcaatattggaacgaatagttcccgttttgggcatagttttgtatcttaatattctcactgtgtataaaaaggtaatccgctttatcaatctgtacgttcttcagctctatattacgacaataccaaaacgtttccaaagcattaggcaactgcacgttttcgagttttattccgtccatttcacggaacatcttcggtgcttctaccaaggtatctgccatttgcagactttgagagtaccatagagcagcacgggctccctctgtaaagagacagtttttcacaatgaatccgttggtatgccaaaaaggatattttccttcaaagcgacagttgattgctataatattactacattctttcaacgcagattcaccggcgtgaattgttacatcttccagttgaaggtcgtgggtcgcgaacagaggacgttcgcctccatattctttatttcttatttgttccattagtttattctttaatctgttatttcaaaagttacatttacgcctcctgaaccaagggcggaggccagtcctgaaggatttgttatacgtcctaaacgggtataagtatatgaagtggaaaaggtttcataaaataggaccacacaagtggaaccgtaaagcatcaagtcacctgtccgaatagtcccgggattggacgacgctgtcggcaaacccttcgacagataataatatttttcattaccatgcagttcggacatatccactgtcatagggagtagtctcttaaatgctttcgctgtctcattattgtccaatgtggcattgaatgaaacaggtccgattgttattttaagattattgctcactggggtatcatcgttattgtcgtcattatcatcgggattattgccattattgttactgccattatcaccggaaccagaaccattacccggagtcacttgttgacctgttccctgtataggttcatcttcgctacatgatgcggaaccgaccgataatgtcagcatagtaagaattgctattatatagtatctcatatttatagtattaaaacttatttctttagatattctttaaagaaagattccagtttattaaatggaataaggcttacacgatcgtaaagatctacgtgtccggcaccgggtactatatacagttctttaggttcggcggccaatcggtaggcatcttcactaaattcacgtgagtgggcattttcaccggtgatgaaaagcatagggcggggtgaaatagtctcaatatcttcgaaaggatagaaattcataaatttcacattactggaaagtgtaggatgagtggtggtcataggagttgctccgtcgggggtaaattctcctctttgtgtacggtagaactcatagaactcccgctcaatcggactggacttttctgtcagttgatgtacagtgccaccggtatatttagtttctccacctaaaaattcagcataacgctgttctgccgcttcagccattatttgctttctctgttccaatgtcaatgagtgttttaacccgttacggctagccgtacccatattgtacatactgattgtcgcaatggctttaaggcgagggtctattttcgctgcactgatagcaaaacttccactaccgcaaataccgattactccaattagattccggtcaacaaacggacgggtacctaaaaaatcaactgcggcactaaagtcttccgcataaacttccggcagaacagcattacgcggctcgccttcactcccaccccaaaaagacaggtctatggagagtgttacaaaaccccgttcggccattttcgttgcgtaaagattcgcgctctgttccttgacagctcccattggatgtccgacaatgattgcaggatatttgtccccttctttcatattcttaggcagaaacaaatttccggctaccttcattttatactggttggaaaaagaaactttctccacacttaccaaatcacttttataaaaattatctgcatctgtctgtgcagaagaaaaactagttccaagcatcatcataaatacagttgttaataataaaatccgtttcatatctcttatttttaattattaaagaattgattatctattttctacgttgcaaaaatagggtgaaataaagagactgtatgtagatgaattactgacattattacccgaattacagattctattttttatcaatctgctataatatctattctaacctatttaaggaaatgaagtaagtatcaaaaccaaggaagccaaagtcagacttcctactttagcgaacgccaaatttattacgagaagtaactaaagaatcattaaacaaaatgagaaaagtcgaaactgaaaaagaattctgatgagtacttccagttcaaaaggataaagacagccccaaaaggcctttaggcaaccacgctaccatactgattgccgacaaattacattttcacttatttattaataaaatctcaatacactaagtcacattgacaaataaatatctgttttgccgaattatcgtcaaatgcctcttcttcaaatccgccatacttatgaataatatgaaaaccattccattccaaatatgaatctaactcttgagggaagaacattctcatatccagattttgaatagagttaaacttgccattgataaaataatgccattcgatacggttaatctgagttttattttcatatcgcattgtctgctttatcaatacttctctaccgtcatcggttgtatatgcagcaatttctttctgctctttttcaccttcaactatatattggatattcggattaaaacaatcaaacagaaataagccaccgtctttgaggtgattcttaacgacattaaataccttaaataaatcttcattcttatataaatgatgaattgaattaaacggaataaagataaagtcgtatttttccggcaaattcaaagttctgatatctgcctcgataaaacttatttctaatcctgcttcggaagctttaatttttgcctgggcaagcattgaaggggtataatcaatcccagtaatatcatatccttcctttgcaatgggcagagtgagcctgcccgtaccacaacaaagttcaagtatccgggcatccttgttttccggcagccatcgcttataaaagtaccaatcatctagattagtattcatcgcatcataaatatttgcatcataaattaaatcgcccactttataatcactattcatatatgttgtcctccaatatatattatctactatttttatgtttatcgtcagtcctattttccaaggtcggtaatataggtaaaataatccgtaatctatatacaaaccgaatctaaaatcagcagtatctttgcagtgtgataaagataataggtataaacgtaaaaaacaaattgatatgtatttagaaaatatttactctcctgcagacgtaaagaagttatcgtttaaagaactcaatgatttaagtaatgaaatccgtgcatcactcctgcaaaagttgagtgaacacggcgggcatttcggccctaatttcggaatggtggaagcgactatcgctttacattatgtattcaactcaccagaagacaagattgtttttgatgtatcgcatcagagttatgtacataagatgctgaccggacggaaagatgcttttctctatccggcagagtatgacaacgtatccggttattccgaaccacaagaaagtaagcatgatttttttgttatcggtcatacttccacttccgtcagcctggctagcggattggcaaaaggacgcgacctgatcggtggcaatgagaatatcatagctgtgataggcgacggttccttaagtggcggcgaagcatttgaaggattggactatatggcggagcttggtacaaacatgattattattgtcaatgacaatcagatgtctattgccgaaaatcacggtggactatataagaacctgaaagaattgcgtgacagtaacggtcagtgcgaatgtaacttcttcaaggcgatgggactggactatatatatgtaaatgacggtaacgatgtacaggcgttgattgaagcattctccaaagtgaaagatattcagcatccgatagtagtacacatcaacactttgaaaggtaaaggttatgaacgtgccgaacaggataaagagacttatcactggcgcactccattcaatccggaaaccggagaagcaaaagtcagttatgaggaagaagattacagcgaagtaaccgctcaatatctgctgaaaaagatgaaagaagattctcgtgtggtgacaatcacttcgggtactcctgccgttctcggattcactccggaccgccgcaaggaagctggcaaacagtttgtagatgtcggtattgcagaagaacacgcagtagctcttgcttcgggtatcgcagccaatggcggaaaacctgtttacggagtgtatagtacatttatccaacgttcatacgatcaactttcgcaagacctctgtatcaataataacccggctgttttgttggtattctggggaacactgtccggaatgaatgatgtaactcacctctgcttcttcgatattccgctcatcagcaatattcctaatatggtttatctggcaccgacttgcaaagaggaatatcttgctatgctagaatggagtatccgccaaaatgaacacccggttgctatccgtgtgccggcaacagatgtaattacttgtggggaaccggtggagactgattatagtgttctcaatcgctataaagtgacgcatcgtggatcgaaagtagccattcttgctttaggttcgttctatggattgggacagtcggttgcatcacttctgaaagaaaaagccaatattgatgcaacactcatcaatccacgttacatcaccggtgtagacaacgaactgatggatgaactgaaagcagatcacgaattagtgattacgttggaagacggtgtattggatggcggtttcggtgaaaagattgcccgttattatggtgctacaaacatgaaagttctgaactttggagctaaaaaagaatttgttgaccgatatgatatacaggaatttctccgtgccaatcatctgacggatgaacagattgtagaagatatcacaacactgatcggttaaaatcaaacccattcactatatattcaggtaggttgatgtatacagtctttaaggacagttgcatcaacctacttccattttcattcaaatcagccaacttattatttaaattcattatattccctattcagttcagtaattccccattcagttcagcaatcctttccgttcaaatcaataatcctttccgataattcaacggagtctgtcccgcatttcttttaaagaacttacaaaaaccggctgcatcactaaaccccagtttagcagcaatctcgccaaccgtaaatttggtagaactcaataaagtacgcgcttccattactaacaattcattaataaggctattgatagtcttacctgttccaaggcgtacaatgcgtgccaggtactgttcactaatagccagtttatccgcataaaagctcacgaaatgttcttccctgaaattacgggtaacgagtgcatgaaattcttgcagaacgtggtctttacgactgatctcttttttgataacggtctttcgggaaagaaaatctgctatatccaaaaacagagaattgcacgctgcctgtatacgccggaaaaggaaatgatgttcaatattcatcagatgcatcaatacttccagctccttatggatgatttgagcttcatactctgtcaactgaatcgtatattgcttattccgcctcatagttgccagcaggattgccgtgatttgtgtcagatatgaatcgtctgtccgcatagattcggaaagggcgagagtgataaatttaatatcccgacttgaataaagatgttccgtgagataatttgctccatgaataagtaacatattcggttctatcgcaataaactctccattcagtagaatttccgaacgaccttcaagaacgaatatcatataaagctcccgattgaaataacattcatttgccggataacttctatctttatattcactccggaaacagactacctcctctttataatgaggaagttcaggatgctccttcaacaactgtgtattatcaaatatacgagattttaccatttacacctttattttatgacgtaaaaatacgatttgtttcggatatgacaaaaactgtatggaattagataatctatttcagagtaaaaaacaggacctttgcatatccttttcaatacatgagaagggaatcaatagaaagaggttaaaaagacatggaaatgaaagagatttttaagaggtatttagtgtttgttatcggactctattttttagcggcaggtatcgtgttgattatacgctcggcattgggaactactcccatatcgagcatcaattatgtattaagcctgaatagtcctttatcgttgggtacttgcacatttatcatcaacatggtgcttatcctgggacagttctggttaatccgaaagaatagaacccgacaggatcttattgaaattcttcttcaactaccgttctcttttatcttttcggcattcattgatttcaatatgatgctgacaagcgaactgcatcccgctaattatggtatgtcgattgctttattacttacaggatgcatggtacagtctatcggagtagtgcttgaactgaaaccaagagtagccatgatgagcgcagaagcatttgtgaaatatgcatcccgccattataacaaggaatttggaaagttcaaagtttattttgatattactttggttacattagccgtgattctctcgctcctgctaactcaaggtattcagggagtacgcgaaggatcactcattgccgcttgtataacggggtatatcgtcagcttcctgaatcagaagataatgactagaaaaaacctccatagattactgccggtctggaagtaagccctatatctatttaaaataaacgccttataaaagaagtcatataaaaaggtcaatataagaaaatcactataaaagaaagtcgcttctttgaaagaatcaatcagattctaacaaagaagcgactctttattttagatataattatactcgtatttacttcttctgactatctatctctttcagaagttcatccacagccatctttagttgggtatcctctcctttgactactgtttccggattattggcaacctttacatccggttccaattgggtattttccaaataactgccgtcaggcaaacgataaccgacgataggaataccaaaaaccagtgaaggatcttgtaaagtttcccaagacacacttgtcatagtacctggaacaggcataccgacaagtttgccaatcttttgatgtttatatacccacggagttccgtgtgcattcgagtagttagcttcacattgcagcataatggaaggtttgttccaacgacgactcggcatatcacaggcttcacgtccgcgtaccacttgtgtaaaatacttctgaccactgaacagtatttcaatatcttcatgcagacggccaccaccgttgaaacgggtatcaatcacaatgccttcgcagttgttatattttccaagaatgtccgagtatacagtacggaagctgtcatctcccatcgactgaatatgaacatatcccaaacgtcctttcgaccatttttcaacatctgccgcacgttgttttacccaacgtttgtataacaatccattcagttgcccgttggtgaccggcatcaccacttcttcccaacgctctttactttgtggattgtagattgaaatcaatgttttcttccctgctttattattcagcaaacaagttatgtcattatcgagagttatctcttctccattaatcttttcaatgatgcaaccagcctttactttggtacgtgaatgatcgaacggacctttttctattacttcggcaatctgcactccttttccctgataattccagtcgaacaagagtccgagattagaagtgacatctccttttcctttgggagaataacgtcctccggtatgtgaaacattcagctcacccaaccactcactcaataattctgcaaagtcataattgttatcaatatgaggcaggaacttatgataagcattagtcatagcatcccagtcaaccccgtgcatattgacattgtagaagcgtttttgatgctgtttgtacacatggtcaaacatcgtttcacgttcggcagccaagtccattttcatttcagcctgatagctgatggacttcaacgcatccgacttggcatccatcttttgcataatccggcttcccaacaaaaagatatctccttttttgtccagcatcaacgatgcccaaccggtattgagtttgtgcagacgcttcgtatctttttcacggagattcattttccaaaggtcatatccaccttcgaacgcagagaaatagtaaagatcttccccgtcttttgaaagtatggcactacccaagtcggatgaattgggagtcagacgcacgatacggtcttcaatgccgttcagctcgacaagtatctctttttggtctgccttatccttgtcgatcttgtctttgtcagcatttcctttatctgctttttccgccttagacttctttgcgtctttcgtcttctcatcgtctttctcctttgccttcttctgttccttttcaaattctttgagtaattcgaaatcttccttactcaaacggtaacgatcataagcatcctgattgagaaacaccaacatcacatcttgctgcgatccccaggaagcatgcgcacgcataccatagcgttcggtttggaaaagaatagcattcccatcgagtacccaacgcggagcaccactgatatatccactatttgtcagattagtagttgcccctccctgtgcgctgacaatgcctacatccgaataaggatcgtggcggttgcctataaattcgagagtgaaccatttaccatcaggcgaccattcgtaatcgaatccacctccggtgttataccatgtagaaccatccgttacctgacgtaccttttttgttttcaaattgagtaccatcaaacgattacggtcttcgataaaagccaattctttaccgtccggtgaatattgcggataagcacgttctaccgttttggacggtaataatacttcctcttcaataagagtagcattagggaaattcgggtcttccttacgacttattttagcggtataaagttgccagttaccggttcgctcactggcataaaccagtgtccgattgtccggagcaaaagaaacggcagcttcttttgccggagtatttgtgatttgcttggtggtagcataatcagttgaagtcacaaacacatcaccacgtacaataaaagcaatttgcttaccgtccggagatacagaagcggaagttgctccctgtgagaatttaagtgtagcaagctgctgcccatcatcacggaccagttctacttttactttttccggacgtgcaccagacttctgtgtgtataactcaccatcataggtataacataaggtacctttatcgctgacagacaaaaaacgtaccgggtgagttttgaaagtagtcatagctttcacttcctgtggagtattcaaagagaaagtatacacattgaaggaacctccatcacgctcacttaaaaaatagatagcattaccatcaggtgcatacacaggattacggtcctctcctccccggtttgtcaggttcgtatgttttcccgtttgggtattatataaccaaatatctctcgtaatggaagaagtatgatgctttctccattcatcctcaaaacctttacgatcctgataaagaaaattcttccctgttttatcaaaacagaccagttcggcaggagtgcccagcacttgctcggtacgtccgccggcaacaggaactttatataattccgtcattgctcctgtaggaaacagggcactgcttgccggatcctgtatagaggcagagaaaaagacatactttccatccggagtaaaagttgacggtatttctgatgcagaatggtaggtcaaccgccgggcggcacctccgtcagcaggcataatgaataagtcaaaatttccattccggtcactggcaaacgcaatttgcttgccatcgggcgaccaaaccggattggcttcataagaggtttgtgtggtgagttgaacagctgttcctccttgtgcagggactttataaatgtcacccttgtaacaaaaaacaatttctgatccatccggtgaaatacgtgcatcacgcatccacaaaggagtaattgcatagctggataatgctgatagtaccagcgctaaagaagttattagtttcttcatatcaaattattataaatttattccgataaatcggtttgaattagttttcccgtgtaattataaaatgtgctgtcaccaaagtctttgtaaaagaaggcatatttatccactcccgtacaatgacaaacgccaatctgtcggggaagatattcctgtaaataatctgcaatgacctgatatttttgtttttccgcattatggatatgaaaacctcccagaagtaacttacaaggagattcgggaaaggcagcctgaaccgtacgcaaaatattggttattccccgatgagaacaggcacttaatacagaaaatccttccggttccaccaataccaccgccaattcatcctgaaaagtatccggtattttgcatccatcttcttgctgaacccaaaaacgttcaaaatgggtatcttcctgatttataatatcaatagagggaaaaaggaaaactccgggaagcagctcggtctgctctgtaataaagcggaaacgggaacgatcgaggttttgtgtatgcatcatcccgttctcacgttcatccttgaatttaggagaaaaaacctcacgcttacagacaacggttgcctgcgtattcaattccaaaaaataacgtagtccgcccgtatgatcgctatgaccatgagataatatcaaataatcgactttttgcaagtcaatatgcaacaagcgggcattacggataaacaagtcagatgctcccgtatcgaaaagtaatctatgttcttgagtctcgatatatagagaaagaccatgttctgcctgcaatttacgtccatagacacaattctccacaagagtcgttattttatagcccatgatacttagttagttatcaaacgaattatacaaaataaaaagttctgccacaaaattataataattctgtggcagaacaagcaatccagtcaattaagtaatcgtaaaaaggggaaaatctggaaaacataaccgtcttttccagatttcccgtcaggttttaaaagttaagttcgaaactatattttaaatattcgaacaatccattttatcatattctttatgaatatctttaatatggaaaacaaacagttacaccatctttcccatattatatgcttcctgcatgtagggagtatctttaatctctcctactttccatgcaccgattccatagaccgtccctttttcctgtggtccttccaagcaatcgaggaagccacggaagccgtcgatagtacgctccatcattgctttatcgttttctgctgccgcaataatgaaataaaattccttattagttatttccgtataacgtgcgcaacaacggtcaatcataatcttcatctgcccggacatagtatagaaataaaccggggttgccattacaatcacatcggcagcaatcatcttctccacgatttccgctgcatcatctttctgtggacagggtttaccgtacatactgcaaacactgcatcccgtacaaggatgaaccgttttgtctttcagaaaaatcttctctacttcattgcccgcctcgatagcacctttcataaattcatcacaaagcaaatccgaattaccacctttacgtggactagacgaaattatcaaaacttttttagccataactttcttttattactttttattttcagaattctttttatcaatgattcatgttgcaaaaatagacaaataaaggtatcctgcatgtagataaattacagagaaagataccataattacagattctatattttacattcgttttaacaactttcttgtatatagttattctacaaatagttctgaaagtttctttcactaatatataatttatatctttgcccgtgatacagacaacatgatacaatgaaaaaaatacaactgaccgactcacataaagaaaagctgtttcaaatccccttattcagggatttacctttaaacatcaaagagtccttattggaaaagctggattttgtaatctatgcggctaataaaaaagagatagtcgttacacaaggaacaccctgcaacaagttatttgtacttttggaaggaaaactacgtacagatattattgacggattaggtaatgaggtgatgattgaatacattatcgctccacgtaccttcgccactcctcatctttttaattcgaacaatactttgccggctactttcactgctcttgaggacagtgtgatacttatggcaaccaaagattcaaccttcaaagtaattagtcaggacccacaagttcttcataattttctttgtatcgcaggtaattgtaacatctgtaccgtatcccgtctgaaacctctttcacgtaaaaccgtacgggaaaggttcattgtctatctatacgaacataagaaaaaagatgcgttagtagtagatatcatgcacacccaatcccagctcgccgaatatttaaatgtgtcacgccctgctctatctaaagaaatcaataagatgatgaaagaaggactcgtcatcatggaaggaaaacgaatcgagattttagataaaacaactttggaaaagtatctgtaacgacgtatttagaaaaatatccgtaacaacagacgtaacaataagagtgtactatcaagaagtggttaaaacaaaaaatcatcctcacttcagatatactgtagtaaggatgattttataaattcaaaaactttcaaaaactctctctttatttaaattctatctattcccttggatttaccacttcacaaacaatatcttcggattaatattcaacgatagccaaccccaatcctgccagcttttatgattgccggttttcacagcgtccatcgtcttcgtgccacgcataaaagaatatccggcagagagtttcacatctttcatgatcgaccagtttatctgataatcgacttccgaacctaaatatttcttcaagtcctgaacctttacggctgtgctaaagtagtgataattaagttccatatccactttgtcagaagcacggaaacggcctccgatacgggcatccatcaatccaggggcataaccgttcgcaaaggtagaagcataaaaataatccattgctccataaaatttatgatgagttccataaagaggatcgaaagctttgtacttaccgccatttcccttatcaccacttagataatcaaagctagccacagctccccatgtatggtcaaacgtataagcagcctgtatgcttcccatcaaagctgaaactttatcagctgctttattcttacccatctgatagtagaaagcaccatccagattccagttactgttcttataagtgaggtaggttcccattgtttgtaagtaacgggtgtgagaatcatccgtagctttatcgcccgtttccaatcccaagttcataaacaataaagaagccccgaacggaacattgtccgccttatagtgataccaaacggtttgcatattcttataaggctgtcccgtagaagaatcatagtaagtgcctccgcttgttctactgtcattattttgattaaaagcaagaatcaaatgcacttcattatttttgttggcatatcctagcttcaacgcatcgtggtaacgacccgctacattccagtccaatcctcccaaaatacgttcatcatcataaatcaacgactgacgtcccagttgggcaaagaatccttcgccaaagttcatctttgcccaagcctcattcagcataaaacgcccgttcttttcaatctgcggatcctgtccccaaacacctacatgctgtgccgacatcttcagttccagatccgaacgtttataatccatcgataaccgcgcacggttattgatgaaggacgtaggagccaccccttcatcccgtggagtcaaggcaccgttccgatactctgcacgaggtctgatttgcatagacatcgtaaattcattctctttctccgtgttttgtgtgtatgccatgcttggcaatagcataagcaagaatgaccaataaaatgttttcattgatagtgcagtttaaatgatttgatatttcaatttaaattatacgtatgtacactgactccttgtgcggacggaagataattgattccataccaacacatttgtaataagacaaaagatactaacaaaataagcaatgccggacgtgcctttaatggctttcccaatctgaaatgaatatatgccagataagcaaaccaagtcgctgccgcccatgtttctttcgggtcccaagcccagtagtgtccccaagcttctttcgcccagatagctcctgtaagcatacctaatgtcataaatgccagacctacataagtgaggttatcgcacaaatccatttctttccgttcaatctttttcttcttgaaccaaagcagataaacagccatcaccgtcgccgctcccaacatagcgtaagcaaacatatacacaatgacatgaggagcaaaccacggactttgcaaagcaggcatcaacgttttattgtgaatctccggtttgaagatattgatacagataaagacgaacgaaaggatgcaactgaaactaagaatccatttatacttccaacgtacgtaggttatcaatcccgccaacggaaggaagaaagaataccacagccgggtctctcccatagttcgcatcggaggacgttccaatgaaatccacattccgataatgaagctgaaaaaaatagccaaccctaagaaagtaaatccataagcccatcccggttttgtccctttccaggcagcaaaagctcctaaagcccaacaaaccagtgcagctattgcaaataatataaagtactcccaattcatgctttgtcctcctcttttctcttttgtgcactgacgaacaagcagacagctcctgccatcatcattataattcctgcgtaaacgaacggtagccacggatcgcgaaccagttcgaagacactgacatcgctccatcgtccttttgtctcgtcatagctaagttgatagattttccatccttctatctccatcggacggttcacttcaatggtaccttccgttatcgttccttcttgtgtatagattttcacttccgacgcaaaccgctgcggttcccgttccggcatcacaagactggttaaagaatccagtcggattgccttataaggaaagagaaaactgccacagcttacccaaccttcttttgttgtttgattcttctgattgacagctttcaggtaaacagcataagttgctcccatcgaatagaattttgtaaacttcacagtatcttcagtagccacagaagctgccatcgggatagattgttcgattgtcaattgccagtcctgtaatgttccctttgtcactccctcttccagcaatacatgtacaggagatttttcgggaagcgtacgcccggtttcgttgtcaatcagcatcagttttggaggatattcgtcgatagtaaaatccttgagttcgatagccaatggaagttcaatcagttgacctttatcgtcagtagcccgccattcggcattgcccatgcgggttgtcattttcaaccgttgcatatcggcgtttcctaaagtggccgctatcaacgcgacgaataatccgatatgattgagaaggaacgaaagtcgtctccacttaaaaggaaagctggcacgaagtatcgtcagtcccaatgcagtgaccatccaaaagtaaagcagaacgaaaggccaggatgcaatcatctgtgagaatcccagcaaatccgttgaagcatttggagcatgaccggaaggagcttgccggataagtcccataactaccgtcatgccgaccacccacaacaaagcggagacggcagcggaataatggcttaaccaactgaataaatacacacgtttacgaagaaggtgcatggctatcaaggcaacgatataaaccagcagcacaatcacgttgaccggacaggcaaacaaatcccagttaatagcacccactgtcatttgcagcaatatgcctattatcagtaatcctgcgccaatcgccaacccttctttataactccacggtttgctccacatatatatctatgcttatatttgttttatatctgcgccaaacgtccattttctttcgctttctccaaccaggcgggaaccgttgttttcaagaatttctctttcgcagctctttcagcgtccatatccaagccgatatattcctgtgcctttgccttcgtcgagatgtccggcatcggaacatcaccagtgtatccgttcttcgccaatactttggatacggcaagacgggcttgcatagcacggtcgagtccgtgagaaaggattctctgaatttcctgcggtgcatggaaagagccgccgtgtgaagccactccgaaatcccaacgccattgtgcctgacgaatcaatgcgagaacatctttcatttgagcttctgtcgctccattatcccaggcaaatttagcttcgatatgcgctttcgccaattcctgttccaagcggttacgaatttcgttcgctttgcgttggcgttcgtaaacgttattgcgcaaagtctcttcgctctcacgatggcaaacctggcaggtacgatcaatcatagccaacggactctgaatatggtgatcgctgaatttcacaccgccttcactcttatacggcatgtgacaatcggcacaagagacacctctttgcccatgaatacccatttgagcaatctcataatcaggatgctgtgctttcagaatcggagtacgactcaatttatggatataatcatagaacccggcctcatcataataagcctccatatcttctaccgtgaaacctttatcccaagggaaagtcaggtatttgccatcacctttgaagaaatattcaacgtgacattgcgcacagaccaatgaacgcatttcttgcggagtagctttggtgatgtctttaccctggcgttggaaagcttcaatcaaagccggacggctgatatgaagattcattgtttccgggtcgtggcaatcagagcagccaatcggatttacgatttcggcccccagagctccccatttattattgtagaaagaatcgacacccaatgcttccatcatccggggaacatccggacttttacaagtccagcaagtagacggttgaggaccatccgtcgggttcacaggtgcaccggtacgtaatgatgccgtgatatcctcaatagcatgcatgtgcccccgtggagtagaataatctttagagaaagcgtaacctgcccatagaatcaccatttcaggacgtttttccaaagcatctacagcaatattcccattaaattcgctttcaaagtcagtctttgcagtttccgtccaagtttgatattcacgggggaaatcatccttgaatagttcatttcgtgcttcaatccccttgatgacgtttttacggttgttgaaaatgctggcaacttccgccctccgttccatcaacgcagaaacgcataatcccaaaacaaatacaacgaccattgaacctccgaacaacagccatccttgccatgattttaatttcttttccattgtatatcggttttattattttattacgtatttcatttcctatttatctttctgattcaccatcttccggagccattcgggaacgggcgattccggaagaggaacaatagcctccggagtgccggacaaagagttttttccaccatgaggaacatcacgatggcaatcccagcaagccttgccctctcctacttgtgacatcatataatcaatcttccccgtcttcacaaattccgtattgagttgtgtatgacagcgaatacaattattcattatcacttcggaactggcttcatgagcctgaatcacctgcggctcgcttttggtaagaaatgcagccacgtgtttcataccgtccacccctttaaaggtccattttttcacagcattttcatgcggcacatgacaatcattgcaggtggcattccgggcatgtgagctatgaaaccaagttgcatagtaaggagtcataatgtgacaattcacacatgcagccgggtcatctccaagataggtatgcgcccggagcatgtacataaacaatgcccctccacccacaataacaccgccaatgatgacagccgctactttccatttaaaagaaggaaagaatcgatttattattggaaacttcatcatacgaaatagaatttttcacaaaagtaaaggattggaaacaaaaaaggtgtaatatctattacacctttcgaaagaaaaaatactctttatacaaaaaacagcctatctatcgtcctgtagccaacagatattccagttcctttatatagttgtctattcattatgatggtggtcttcatcttccacctcattgctcaatttaatattgcgcgcgatataagattcgttgcctgcggcatctgtgcaataaaccatcaaatgataatcccctgcagtcgcattggctggtattacaatatcgtgatgatgaatatgtgctgttttctgtcctgacacatcatacgatctgttaaaactaaaatctactgtttcctgcacagccctactattaccgccgtgtgaatgatggtcgaaattgctatgaatttcgatcttataggatttcagcataacatcatccgacaaatccatttcaaaatgaactccatgttcgtttccgatctccaatgcctgaccttcttccggttcatgaagttcaatcaaaggtttgatcgtatcgctggagtcatcattatcacaagaggaaaacatgaaagtaactgttgccaaaaggctaaccattgggagataaaatttatttttcatttcagtaattttttaaatggaactttgattaatatctggaagttacgtcccggttcgggaatctcaactttcctgtaaaaactaagatgattgtaatatcgggtattgaatatattccgggcggtcagggtaatttcaatttcattatttccacctatcggaatgtttaaagatccgcccaaatggaagagatttgctccggctgtacggtcttcgttacggtccactctattttgccgagcaatgctctgccattctgcatacaacatataccggttcttttgccaggttaatgtattgcgcataacaggtggcggcgagaaactcaatggaatatgttcatcacaattataggtgtaaacgtattcagcggaaatccgataattgaagttacgcagaaaatcaacatctacggtagcttcagttcctgcgaacagtgcttccgctccggtatagcgatagatttgtccggcatgaggcaatacagaccactctccggtaggacgcagaaagatgtaattgctgaaccaactgacaaatggagagacggagaaagaaattctccggtacttcagatgataagaagcgtccagttgccagccctgttccgattttaaattggcatctccctgttcatggcggaaagtgccgtgatgtactccgttggcagccaactcattcgcaccgggcaggcggaaactacgcccgatattcacctttaccagatgcttgtcggagggagtccataccaatcccagagaaagagaataatcaccatagtgttttttcacctggtgactgttccacttataaaggtctatctgttcctgggtatatccctgtttttgaagataatcggcaaggtaaacatcttcatgcgaagaaatatttatgtatccgtagtcataccgagctcctccgctgacggagagcacattgttaggtctgtacgttgtaagccagagcattccggtggtggaacggtgatattcgggcaataaaaacgaatagccggcaatgtcattccgttgatgctgtccatcccaccccaatgtatgttcccatgaagaagatccgataaaacgagctttcactgaagcactgaaggtgttcagattaaatgcgagttctttgtcggggtctttctctggtgcgggttgcgagccatagtgagtatggaaagcactccattcttcacggtgattgttctggaaacccaaatcacctgacaagatcagtttctcccacgcatattgctgatggatggtcaccttcaggtgattcactttgctataaggcaattcgatattacggctgtctccatcatcttccacacgggacgcatcgggtatgccatgcgctccggggaagaaacctgtcttttgatagacattactcacggagaaattcgctctatatgcccttcgctgatattgggtaaagagtccgatattgcgttcaatgcctgctgtattcttcagtttacgcccatagatggggattctctgtgtcaggtagacaatagaatccgtaggaatatgatagtcgccgaagtgctgttccgaataacgaatgtgagagtaccatgcatttttcctgattcccagcatcagtgatcctccgacggttccattgactgatttaccaagcagtgtgacatctccaaacacccgattatccacaggcacggccggtggaacgacatctatcactcctcccatcgcatcactgccataaagcaatgaggaggggcctttcaaaacattgaccgctcctatattgaaggcatccaattctaaaccgtgatcggctccccattgttgtccttcctgcttgattccgttttccaatacagcaatccggttgaatcccattccgcgaatcatcggtttggaaaatcccgaaccgatatccattgcctgcactccgggaatgttctccatcgcttgcatgaagtttcctgtaaaatgtttgcgcagaaaatcctgatctgctatatcaaccgtaagggcagactttttcacttgacgctgctggtacgtttcggtcaccacaacatcaggcaaaagcatactcttgattgaatcggatttctgtgcatggacggataaggttataaatacccctattacgcccgaaataattccgatacgcatcaattacaatcttttatataatgtgcaaaatgaataggaggacagattgaaggtcaatctatctcctttgaaaatatgattatgtaatcaagcaacgggaggtccgcgtaaatgatgcgaataagttcgtttgcaaacaaccttatcctgataaataaccggctcgtatgggacgagcgtcaatgtacaatgaaattctaccggttgaggttccgtaaaaagagaaagggagtatttacatatcgcacaatcatcagaaggattatgggaatgttttgcatgggaacatgatgtctcatcttcacttccatgatagtgaaaggttttcaccacaaagaaaggaatgaatgtcatcaacaacacccacgctatatatacctttatgtttctcttttgatacattctccctctattgataatatagaatagcgaggacaaatatagatgtatgaaagagaaggtgcaaattatcaggcttaatatgtgttatcgtgaacgatcaaaaagaatcaataacacaccctattcgattttaatctctttcaatgccaaaatggagatatacacaactatgccaatagaatattacgcattattttatcaggaaaagccatataatatttatcttttaaagttatcactccataaaagaataaaataataggataaaatcttatatcaaaaacgttctgtttatcaagtttctttgaaaggtcggctacattataaggcaactcatcatcaataatcaatgcatccaacatcgctttcgcgttatccagtgaaagggtaagccgacgaatccaattaatatcggtacgtagattttcatccaccagttcgtcgggaatactaccagcattggccgcaaacttcttgaagaaataagtcaggatagtagcattgaacaaccgatcaccattgggacggaaacgataaccatcgtagttgctcacaattagctgccagatttcatcgaaacgttcctgtcctgtggagtatttgtcaagtacataacgcaagtatgtctctgtctcttcgtatgtaaacccgagcatattcagaaaattaggttcaagagtcaatatctctgctatgttatatccactggtcaaatcatccatcgtagcaggtaatacacctgtacagaaacaggtacggatactcccctcacctattccggcttttatcactttaaagaaagtacgcaaaaaactgtcattcgtcgtcacttcctcataaagcggatcgttgtatgctgtaagcaactgattagtgaagttatcatattcatcaatcaatagataaacttttggaaattcatgagaacgggcataattaagaacttcttccaacattttggaagcgtctccccgagtagtaaactgaaaatcaccgaacaaatctctgttatgctctaccatcacatctaccgagccacagttcaaatcattaaagttttgagccaacccttcaatagtatccgccattaccattttcgaaaaatcgtagcgaataatcatataactgttatgctcttttgtcggatggttacctatccaggttcccccaaacagttcttcaaaccgatgcgcttttgtacggtcataatagcaagctaatgtagaaaccaacaaactttttccaaaacgacggggacggagaaatacaggagcattataatcctctaatttaggaatataatcagtcttatcaacataataaaaaccacgttcacgcaaatctatgaaatccgctactgcataaggaatagttattcttgccataatcttactattttctctatatacaaacaaaggtacaaaattgttagcaaaaagaaggacaattacttattataatattattcttcctgtttccatacataaaacacattccttcccgcccctctcttacgcagttttccctcctgaataaaagtattcaaatcatcaacagctttcagccgggctactcctgtcagtctgctgtattctatgcgggtgattcctccattcttcttcagaaactcctgtaacatttgaagacgttgctcgataggtatctccgttttactgacagtccgtcccgatttgggcacacgttcaagtctcatttcccgtcttaccttcaatttaaaatttttggaggtacgcaggtgtacattgtcaaaacagatagattcggaacggatttcttttttagtcattaccttctgagtgcatttcaaagagacactaagatgtcccagctctccaagctccacaatatagccacgcgccaagagactaccaagttcatctattacagcccccaacaccccgtcaaccatattctggggaaaatgttgataacgtgacacacgttctataaactctttttgggaataagtcccgctcggaactatccgcgcatgaaggggttgcttctcgccggtattctgaacgtccggtgtctcatacaaatcataatacgcactcataagcagctatattttattgattatcatttatcattttcttgcctgatatttaatctctcttataccaatcattagttcttggctagcatatatttattcgtctgactatagtgtaacttgcatctgactatagttattctttcgtctgactatagttagacgaaaaagtaactatagtcagacgattagtttattgcatacaaagatatactttatcgcaatacaacttataaatattaggaagaaaagattcagttaaccgctagaaattaatcacccaacagcaacttagtcacagcagccgtattcaatgcccattcacgggtatatacttcatcggcttccggtgtatcagccaacttcaaaccctgtgcttgtgctttgattgccaacagttcgcccacagtggttttggcttccagtttatccagatacttttcaatagtctgtgtatccaaagaaagaaccgtctgtccgccgaaaggaatttccaaccataccacttcccgttccttcactttcaggactccgaaaacaagtcctttctgcacgctttgagaaactcgcacctgatgctgaacacaagaagggtcataagccactccgtttctctccgatattttcatcgggtaagcggagttcatccaacctaccaccagattaggagagatagccccattgctatacgcattgcaggtgaaagcaacatattgcgcacctacacggctcaactcattcaaatccaattcgatatactcggcagtacctttcttgtcggggatgcttcggatatctccgctatgtttagcaccaataacagtcagattgaagtaggaacatacttctgtcgttgaaggcaaagtgatatgacaactcaagtccatatccaaatgctgtgccggaagtccttttccccattgcataaacaatcgaactttatctccttccaccgggaaacgtgtaccctgcaaggcacaggaagtatcctgaaccgtttcgctacggtcgccgatagacaatggaatatgaaacaacataggatcaatatacatacttgcgcttccactcccgacacccgcattagcaaagcgggcagcaacaacctctttacacaaatcctgtacctctttcaccatctctttaagctggtcttccatataaagactcaccaaatagtgaggctctatcaaaagcgcattaccacctaaaggcttcaccattctcttatgtccttgctcaaagtaactctccgcatacatacccaaagtgaccaccaaacgagccggcaacaaatgaacgacttctttaaatgccgtcaacgtctcttccggaccgaaccaaagcatattggcaaacaaggaacgtgcaaacatacccggacgttgcttcaacaaagcgaatgtctgtgtcgcatctgctttcaaacggctacgctccacttctccctgccaaactgtatatgcctgacagtagaatacgtccatcaactctttcaaattttcgaatcccggtttacgagcatattccgccaaacgcaatgcacgtatcatacgtacccacatttcccttttcggatgcatcatttcacaagacttctccggtgtcatcgccaaattgttcaaccaaagagccaccattttacactcgcgacgggtatatttcagttttaattcttcccgctttgcctgggcagccgaacggcttttatccaaagcattgcacagatgtgcattgtttctacccgctttacgaatgagggccttcggctctatgatttgcaagaatccggttttcttataccacaaataacgcaatatatcattcggagcagagaaataaatctgcgcttcctgtgccctatcctgctctaccagtgtgtcgatcaccagcattagagtttctttcatcttgattccgactgccggcaacggaagttcagccagcaagattttcaagctgtccgcttgtgttgcatcaagggccgtacgtgattccagcaagtcaccaaagaaaacattcagctctttttcctgccaaagttccaacactttcagtttactggcttgtccgaaatattctgtagatgccgtttcaaacggagttccgcagaacggacaaccgttgtatcgttccaaggggaatgtattatcaggaatcacgtgtccgcaagatagtttcacacctttcttactattgaacatattagcaagccatgtaatccaatgatccaaacgtgtttctccggtaggtgtatcccagcctttcaccaatggagcccagttgagtgacacacccaatacttctttcatcacctgaagaatctccacctgttgtgccggatacaactgattgacagcatgcagcaactcttcggataagctatatcccacttttcgaagttgagcaaccaatgttacagtagtcgaagtcaatgcttcgcgcttttcagttccttctatcgctggcaaataaattgcatgttgcctgatagatactttcaacaaatcttttttcatacgttgtgttttttaagtaaggtaatcggaagactgtgaatcaatggtgcattcctgcggttttgaagtaagtcttccttgaccttagtttataaaaaagaggtagaacaggccggagtcgaaccgacgaccgtaactacccactgagctactgcccctttgcgaaactggaaaaacggataatcgtactggtatgttctacctaaaaaagtgtgttgaagtaacctgtacttgacctgttttcttgtttcttcgacaaagatagatgcagtgatgcgcagtctttttgcgtaactcaaacttttttttcggaaaaggggccactctctatatgatttaaaatataaagtatcttgttttatatttcttgtttaataaacgctggccgattgaataacaatcttttccagcaacttctgcatctttccaatcaccggttctttatcaagcccatattctgtcgccatcacatcttgagcattcttgccgtggtcgaatttcgcaaatactgggattcccatatttttcaatgtttgttcgatacgcgccattgtctctactacaccgaactggctttcataagtgtaaagcaagttattggctgccaaaggatgaaattgtataggatagaggaaaaaactaacagattcctttgtgaataattagacaaaaccgtatctttagaggcataattatatacagcaaaacaatatgaatataatttactgataaacaaaacattaaaagtcagaataagaaattatagcatatagtgtaaatttatcaaatattgtaattggatagacaaggagacaacttataggtagtcatataatatagataatatgactgatgaaataaagaatataaaaacaacagcgatgtacgtccatatagcaaacacttacaaaagcaaaattaaaagcctgttggacgatattttagaagaagagatttaattaaatacttagaaaaaacaacagcgaaacattaaatgaccgctgttagcataacgttagcattgaaaataaactgagaaaatgatccaattaaaaagaaaagaagctattaggttaataaaataccaccatcttctccatttatcaaatgaagaaaaggcagatataatatctgattataattccaaaataaaagtatatgacaaaagcaacagtttggattttaaagagattcaaaaatatagtaataataagtatatacttgatcgattttcatataatgatttagttactaatgaatacattgaagagattttctttgctttatataatattcatattgagttaattgataagccggtgtcattattaggatattgttgtccatgttgtaactataaagtatatagaaaaatggaaatatttgatatttgccctgtttgtatgtgggaaaatacaaatactggagaagatcaatatagtgcccctaatcgttctacattaaaagagtatcgacaagcgtttttaaataatcaaaagttagagcctaataatcttaaatatatacagtatgaattagggagtatttaattgggaaacaatatatcaaaatcaacaataaaaacatcatgataaagtaaaaataaatgctaacaaacggcttaacttccgaaaagttagttagccgatagacattagcaataaatcaataataaaatggaagatataaacataaaagatttagaggtgcgaaaagagatcgcatgcggagatattatcatcaagctatacacgccacctgttaaacaaaggtacaacaggaacatcacaggcgaaaatattgatggagagattctttggcagatagaagatgtgagaccaaacgtcgactccccctttatgaacataatactttatgatgagaaaaagatagaggcatataactgggagggcgtcttctactatgtccatatatatactggtaaagtggagtctattccaaatcaaagaccgtggtgaaacaaaaaacattgctaacaagcacctgttccgcctaacggcggcaagctgcaagccattatcggtcaaacaataaaaagaaaaagtttatgaaactacgagaagaaatagaacctaaaattattcaaatagaaaaaatatgtctgcaaatatcgaggttactacgtgggtatgatagtgaaaaggacaataaatgtttgaatataataaagaaaatttctgaattaactcacaaagttattactaaagatattctttctgaatatatggaagatgactctatttgtatggttgctcttaggctttcaatagggactccaccattactccatattccattatcgtgtgacgaacttcttgaaatcatacaaagaatacattctaagaattatgtcgaatataaagttaaggcttttcctgaagatgaactttggtggattctgtcacacgattattatgttccgttattggaaaaaaacatggaattatcagaaccttcgcttattcgtgaaatgctatatcaagaaactgtatttgacagtttgcggtataagccggaagaagtacttgaaaaaattttaggtgtaatgaaatagaccgataacaaacagcaaaccgactgaataagcggaacgctgtcaaacattagctgccaattaaaaaaataatgaatatggaactgatacaaacttttaagaagtcatattttctaaagatgtcgaacgataaacatttgattgcacaagttaacagtagtcagataaacatctttgaaaatgaaacatataagcatttagcacaattcaaagaagtaggcaatgcttctgttttcttttcaaatgacagcaacttgctcttggcaaaagataatgatcgtaaacttgttgtgtatgatttggcaactatgtcaatccgttgcaaactcaaaccgaaagtaggcagttcaaatggtgatggtgacgcttgtatttcacatgataataagtatatcattaatttggggtatgattttccatacggctatatatcggtttatgatattgaaaacggaaaggaaacaagatttcgtgaagatatgagagaagtgtataaccaaatacgttatatcccttcacgccaattatacttcattgatgggtttcgcaaaccgaacgaagggacaagtgaaaagaataggtacttctatctttggtttgatatggacaacagaacatttgaacaaacattctgtgatttggacgatgcaaattttctgtatagtgaacatttagagcaagtgttatactttacagaagagggcaatcttgcttttcgcattttgcccttgaatatagaactgccgattaaacaccaacaaggctgtttggatatacaactttcgcataacaacaagatgattgccttatatcaagataataatctaaaactttgtacgttccctaatatggaaatattggctgaattatcgaatatcggctatggtaatatttccttctctcctgatgataaagaaatattaattgcaagtacaataaaagggcttatttataaattggaaaagtgcagctaacaagcacctgtgccacctaacggcggcaagccgcataatattaccaacagagtaaaaaaatgaaagtatatagaatagcaataaatatgattaagcaaaccaagattttaaaatttataatccctattgtagtattcattctattgtatgctgtctcaacaattagaaataacaatgtaagaaaagatggcatatattctatcgtaactcttgtcaaatacggttctgcttatagagggcaaagtgcaaaatatgaatttatatataataagactttatatgaaggaagtttttttatatcatttgccgagagtaaaaacactccaatcggaacccgttactttgtaacattcttagccaaagcccccgaccgacatcttatattagacagcgtaccatcttggtttactctaaaagcaccagataaaggatggaaaacattacctacacaaaaacaactacgaataatgatgaaagatagcttgaattaaaatgctgccaccggacattaacttgataataaataaacgaaaaatgaaacagaaatactatataatcaaactcttattgaaaatatggtttggaatattatgtattagtctattgtgtaccacgggtattctttggctaaagactcaaaatataaaacctgtaccagatatggatgtttcttatagaggtatggcattggcttggtcaattttgggaattttggcattatctaccggagcaatcactttgttcttgaactgctttgcaagagttagaaacagcatactgtatagtttcctatcattttttcttattcctattttgataattttattttctggaacaatgtgcttgtatgatactacaataccatttttactttgtttattggcgtcatacatattgtttagaaataaaataatacagaaaacaagcggatgaatcgccctgatggtcgattagccaccagacgttatcagaatatatatgataaaaatcagagtataggattgaagcacataacgtatatttgcagtctacttcaatgaaatagatgaaatcataaaagtaatttgaatatgaaacactttaaaataataacgatgggaatacttgcctctattctgagtttactgggatgtggatatggaaacaagcgagctacgcagagtgagagtataaatccttatattccggtagccgcacagattacaatggataagttgtcgggcgtgctgaaaaacgtacaggcaggacgaacggaatatgattttacgggtatctgtgctaatggtgtggattgtatctatttcatgcaggataacggaaagttctacattgattttgaagccatgagcaaagaccaacttccctatctggatacattgaagcagtttgccaaagagcataattacccaattatcgaaacgacctataacaacacgcccatagattacgatcatgtgaaatttgctccggttctaagcctgaaagtcaatgcagatattgacagcatcgttcatgttggaaaattgattgaacaaaccattttcaagaataacgatcagaccatttacgatatagtgccttagagggtataaggagaatataaaagaataatgataaaatgagagataaggattccgggaaaaagatattctggatttaccctacaaataagtttgtttgggcaggagttgtcatatgtagtatattctgtgcatttatgatctactttttatgtgtagccaatttaagtgagaataaagtcctctttattttcctgttgcccatatctttgtctatcctgttaatctgttgggcactacccagtaagattttgctttgcgaagatagaatagaagcacgaagcctgttcgggaaaagaagcatccaggtggatgagataaactcgtggggagttgtgcaaatatataagccctaccgttgtaaagagggtatttattcttacatacctgccaagtcattcaaaccttcccgtaaaatagaggagaacatgattttctcgtatagcctgtttttatccaatattccgcactatgacgggaaaaagaaaaattcgtcccaaacagataaaactatttttgtcagttatcggaaagaagtgtatattgcattggaaaagtatctgaaagaaaaaaaataatgtattaatattagtatatatgaaagaatttggaactatcggagatttaatcaatgcttataaagcaataccatgtgacgcttatatctattgctcaaaaagtgttattgaaacagagaacttggagaatagcaaatatttagtcattgaatcggaagaagaggatggatatgtagaaacagaagatggtgaagtccccaaacaagcatacgatttgggcatgagttcgttggtcgatgttgaaacatttaaggatatattgagctttcaatataaattgaatcccaaaacattatacaaagattgtataaaggctattgagtattatctaagtaatgatgattttctggatgaatgaaatcaatcttatgaaaaagttattgtatttgcttgtcatgccattgatattggcggcatgtaacccaaaagttgaattgaccagtgccggaatgtacccgaactatcaagtgggtgaaatagtaaaccttattccggtggattctctgacttatggggacgtaatcgcatatcattcatacattcccggctttcaggaaagggcatttaaacgaattgtcggactaccgggcgatactgtccgctttcaggatcagcaatgtatcgtgaacggcaaaaagtgtgaatgggtactcatacggaaacttttctatgaagaagatgaatgtgaagagtattgcgaaagtctgcccaatggcatgaaggtgaacatctgtaaaagcgttgtacccatagattcggcaacggctaccacgactgcggttgtcgtcccggcgggcagctacttcgttgcgggggattacaggggcggctcgattgacagccgttcgcaaggatgcgtagctgcggattcaattatcgggaaaggtgtaaaaagaaagtaagtacagggctttagttccgatttattatgctgaatacaatgaataaaagaatcatttcatttgtctgtgcagggttggtcgcaacaagttgcgtgtcctcactctgtttctatgattattttgccaacgatggcactaccagcaatcccatctattggattttcgacttttttcagttatccatactgctgggacaagccggaataggcgtttatactatcaatgtgctcctacggcagaggaaagaagccatttcttctctaggatattttgcggctcacgtatttctgcaaaatataactcccttgctccaagcatggtctgcggctgtcattacggaatatccgcaatggttgctgatgagtcaggtcggttttagcattgttctttttcttactttgctaatcatccagcctgcatctttattcaaaaagtcggaatatatcccctggctgttgatggctgcattttatatcaactgcgtatatacggcacttaccatcatcggtttaattattaccctgtaatgattgcatataaacagaatccagcacagcaccttcccaatgaatagcaggcgggtattgtttccaacctctttccggtggggacagtacccatgtggggacaaactcgtcccccaaagccttattgtattcagggttgctgacggcatacctcactatgatgcgcaaaggattgctgacacccaaaaatttgggatatgtcgttgtagtattatatttcaccccatccacataaaaaccgaactggcgtaccttatgtccccctttaatgacacccgacactttttcataagtggctaaagtgtatcgattgccttctgccaacgcacgggctttatgtatgctattgtaccatgtccagccggaacctgacattgcgaaaagatataaaaggtaaatggataacgaagtctttttcccatccgtagcccactgctttttcaatagcgagcctactatcataacaaaagcccccacccctaacagggagacacaaaccaaaaccggaatattcatgtactctatcatactgttttagaatattcttttcttcaaataatatacccataaatcaatagctttgccgataacgacaccaaaaacactaagtgccaacgctatgtaagctgcaacaatgaacggttgttcgtctatccacttattgacaagtacggacatccgggaaaagacaccacccgcaacagtcagaacgatggtcagggcaatatgtatctccaccagcttatcctgtctgtttgaatctatttcgtcatcttttaaatacctgacaagccacaggcacggaacaaacagaaacaacatgaaaaatgcaataattaccatttcttccccggagatttcatgcaatcctctgccgaaaaagcgaaaaccgaatattattgctatacaggaagttatcatttatgccactatttttagtttgtattcttaatcgtacattctttctcaatagcctgacaattcgtttcccggctatcctaattcttaccaccgaaagcgcatctacgaagaatagaattgtatcggctttgttactaataactcctgattcatataggattctttagtttacaaagttacggatatgacaggaaaaaggcaaatttaaatcaagaaaagataataaacacgcggatatacgatattgataacaataacaaacagcacttcaatctacaaagcaagcatccggagatacctgtatcgtttcaatagagatcaacaattagactgataggtactttcaactaatcttttttcatacattgtgttttaagtaaggtaatcggaagactgtgaatcaatggagcattcctgcagtgttgaagtaagtcttccttgaccttaagttgataaaaagaggtagaacaggccggattcgaaccagcaatatccaccgttaagaagtaagccccggttgacctcatttcagataatcccgaagctactgtcctacctctatatttgtttttttgtggagcaggctggagtcgaaccgacgaccgtctctacccactgagctactgcccctttacgaaacaggaaaacagataatcgtactggtaatgttctaccttaaagagtgtgttgaagtaacccgtacttgacctgttttcttatttcttcgacaaagataggcgtagtggtgcgcaacctttttgcgtaactcaaacttttttgctgttttctcgaaaaaatagtaaaaaatgaataaacaagacttattttgtaaaaatacagaagaaatacgaagacatataggtgataactcaacagttttcctacttttgtgtatagtagagacattactctctcccaacaataaacacacaatattatgaaaagagcatttatttataaagacgagaaatctcataaattttggtggattgattatagtggctgtgattttgctgtaaactatggtaagttcgacagtatcggtaaatttgaaatcaaagacttcgatacagaagaagaatgcctgaaacaagcagagaaacttattcactcgaaaaagaaaaaaggatatgtagaagacgccaacttcgacttcatgcacagattttatattgattccgaagaatatggtttgcaccccaaaacttctcatccccgatttaccgaacacttcacggaagaactctattatgattgcgtagacgaagaagcaccttttggtagcgatgagggaagtgatacgttagattctcttgaagaaacgatcagaaaaaatcccaaactcaactttcttgattatcccaagtatctgatagaacacgactggggcatggaatatattcctgttgaaagtcttgaccccgaagtggttaaaaaactagcttcaaagaaagaaatggatatgacacaaagcgacatggtgacttacgctactgcctttggacaaataaaaatcactgggcgtctctcacccaaattacaagaacagggagttaaagctatcaaaagattagctttactttggggaaatggggtgaccgagattcaaagcagaatgattgatgacttactttcatttcctattgataaggactgataatatgaaactaataggtagtaaatatatgagaataatagagattaggaactacactatgaggtgtggttattaacgcattagcaacaatcaaatcattatcgttattatggatatagaaagaatacttaaaacaagagaaaatgcaatatactacggcattggtgaataccaaaaagactgctttggttgggttggtggaaatgctccagcttgttttgatgataagtatttatcggacaaagataatctctatttttatctaacatttcaaaaccctctaaatccgaacaagcaaatatctattttcactccggattttgatattgcattggaatataacacatatcccgattgtaaattgttgttggttgaacatgaattaagtagccaaagtaaaagtgatagatataaacaccccgaaatagatgaaatttattcaatatacgaaatgagtacggaaaaagatatgcctgaaaaaaattgtgcaatcaagtttgggggtaacgtaatgcctattcaatggggattagataatgatggtaaagtggttaaagatggaaatagcttcatttttcaaatcaacgaaatttgcatgaaagatatttccgttttcatggctggctgtatatatgtttatggaaaaattgaaggtaataaagtcacaaatccatttgtggcatactgggaatattcctaataacgataaaatgattaattatttcaaataggttgctaacaacgaaagatagcatctgacgatgctcctttctaaccattataagcaatagaaaaacggaaacaatatgataaaatacatttcgggagatatattacagagtaaagatgagtacatagcacaaggtgtagctgttggctcacaagaaggattaggaactgggcttgcctttaagctgtcaagtcaattccctgaaatccaaaaactctttaagaagtacacacgaaacactaagttccaggctggcaatgtgtttataggagaaatcaaaggtttctctccgggtataatctacatcgctacacaacccgatatgtatcatgcggaactcacatatctgaataaaggtttgaaacgcttgaaaaaagtgtgcgaaagcagaggtatcaaaaccgtgtcgctaccgaaaataggtgcagggctgggtaagttagattggaatagtgaggtcaaacctttgcttgaaagtattttatcagattgtgaaacggtattcaatgtatatgaagattacaagattgaatacgaaatttagcttacaacatacacctgtcctgcctaacggcggcaagctgcaaaccattatcagcataaaacattaatacaaaaaagaatgttgataatgaaataggaaataaaagaattaattgatttttggctgtaatttatctatatagctatgtcacctattattaataacaattgccacatgatatggaacaaaagaaattaactgaattatcattagacgagctttggcaattattccccataaccctgactgcacaccaagactattggacagattggtataaggaagaagcggagttgctgaaagagagacttccctgtattgaacgtattagccatataggtagcacagcaattaaagaaatttgggcaaagcctaccatagatatacttgtggaaatcccaagagaagaaaaagtcgtcaatttgaaaggtacaattgaaagatgcggctatatctgcatggcagagaacgacagtcgcattgatttcaataaaggttatacattacaaggatttgctgaacgggtatttcatctacacttatgttatgagggagataatgatgaattgtatttcagagattatcttcaagcaaatacagctattgcgaaagaatatgaacggcttaaacttgatttatggaaacaatatgaacatgacagaaatatgtacacttcccacaaaggtgatttcgtaaaacaatatacacagaaagggaaactgctttttacaggcagatacgacaataagtaataaaaaaactcttcataaatgtaaatccccaatagatataagcttaagttagtataacacgatgcaggcatccggagatacctgcatcgtctcaatagagatcaacgatttgccttgcggttcttcacttcttccacgagtttggtaaatgatttttcttttttgcgtttctcatgttcggaagcagaaaagtgccacgcttcccggcgaagtttcagatagctcgcataaactttataatctaatacaccactgttgactgcttctaaaacagcacagcccggttcgttgatatgtttgcaatctttaaagcgacacaattcagcatagtcagagatttccaacacttcggcaagagaatcgggattgtcaatggccaagccaaattcacggacgcccggagtgtcgattaaaacacccgaactgtccatcaataccatttcacgacgggtcgaagtatgacggccttttcctgtggacaggcttatatcagatgtgagcaataccggcttttcacaaagagcattcaccaaagagcttttcccgacacccgaagaaccgacaaacacaaccgtttcgccttccgatatggacttccgtaaccggacaattgtttcgagctgatgaatactcgtgaaaaatacgggtatctgactggagatatgttttatttgttcctcaacactctgtctgtcaaaatctaaatcggctttattaagaaccaatacagagctgatattttcctccattatctgaaccataaagcgttctaccctgtgaacattgaaattatcatcaaggctctgcacaataaatgccttatcgacataagaagcaatggcctgcttatcagcaaccgtgccacttttcttgcgatacaatgtccgctcacgaggcaaactatcaactataatccctttatgttcatcgaacggttgaaaaatgacccaatcacctgtacaaggtaattcatcatccgattttccatacatcatatttcccgtgagttcacactgaaacaatccgtttccggaaattacctcgtagcaagtacggtgtacaatggaaacacgcccatgagcaagggcactatatattgattcttgttttagctgattgagtttctcattccaaccataaatagttaggttatcgtcggatttgtgaattgtttgattttcgttattcatgatcttaatatatagagcgcacacgttgaaaagcataacaatgcttttcacaccattgtacgcaagttaaaaattgaatttataaaaacatagaaaacaccctcgaatggaatcatccgagagcaaacgaaaggacaacctgtgtcagaaacacagattgtttatcaaaccaaatccgatttattatttttagtcatgccacaaagataggcattttttatttgatggcaaaacgggcagtcatttcatatctcaacttgatgacacggtactgttcggtagcagccgtccccatgctgacattgctctgtgcctgaaaaggaagataacggcttatattattatcaacaggttctacaatacggatcacttcacccaattcctgtcccatcgcttccaccaagtaagatgctttttcacgggcagctttcaatgcttcaatcttaccttgcttccgatacattggcaaatccttatgcttcaattctccgatgcgcatggactcaattccccatgtgttaacagaacggataatggaattaatctgctcaaaatcggtcaactggatatccaattgcttacctatcagaaattcctttcctctctggcgccaataatcccctatttcctgtgtacggatagcatcatccgctattccgattttgcgcaaactccgacgcaaatccttttcaatcatagccaatggcacttttgtccgaaaatcttcttctttattagatttacctgtgtactcttcctgccaatactccttaatctgaatcagaaaatgtatttcatccggaacgacttcaatctccgaagaacctgtcacttcaatatatttcccatcactttcttgagcattgacaaccatactccatgcaaacaaaacaaaagctaataaaaatacctttttcatatctttaattttatagtacaacctcatttacagcatccgaatgattatatcacaaagctattaaaaaaaactgtaaaatcgaccttattccaaaatatcaatcaagctttttcgatctatcaaaattatatctccattctttaccttacactttggagacgtcttaccggaaagcaaagaaatatttccttcttcaaacaaatgcttcaaccgggtagtggaaagagaaaaacatctttttatcaatgataataatttcaggttcaattcaaaatcacattcgatcagaatacttattatcgcgttgttcatattcataatatcttcgaaggagatattacttatcacctcatattcagcgctatcgtagtctatttgaagcttgttcttacttgccattccggctgaaaaagcatactgccaggccacttctctatcattcatagaaaagctatgaaacagttttttatcaatcaagtccggtttggtacgtgacagcaaagttatattacaagtattatcgcacttcacgcatctgtaaatcagccagacatcaatgttctttttctgtgcattcattctgaacttatcactgcaataaaagcgatcactctcacagtggctgcatttcttaatcaataaaggagtattcttcacctttatctcccatgtaaatgttgtttccataattatacaaaagctattatctttctttgtgaatcaaatctttttctccgcaaagttggatattagccatttgtataattcacaagatgtcacaagacgacatgaaatttatttgtccagctcatccatcatctttataattttatctttcaacttatcaagaaactgcgtccgactcttcttccggtttctgatttccaagaatatgcgataaaagtctccaatctcaatattgaaaagagtctcgcagcagaaggctatgtcttttaaactggtatttccattgttgaagcatttgcccgcatacagggcatagataaactcaaccaaagcgaccttgctgtccgtccactgcaatagccggttttctaccattgaagtgaatttcaaatgaagttcctctgataatatctctatttgagcagacaggtattccgctaaacgattgttggctatgatttcagccacacttgaatcatgcagggtagtgaaagaagaatccctgtccagcaacccgaaacgggtgtctgccagaatatcatagtttcttctgacaaaatattgttcgtcgagttccgtcctgccggtacggtaataatcatagaaagaattattcaggaagtattttttcaagttctccagttccgacttcagatatttgcattgggaagacggagattcgccgatacgcttcttttcaatctgatacaagcggacataaaacatcaacagcccggaaatctgtggtttccaggtcttaaagaaaagaatttcttctttcggattcgggaattggtattcggcaacggcggatttcaacagaataagagacatctgtatgacatcaataatctgcttaatcttatctagtggggcaatcggctgtcgctcaattctttcaatctctttttctatgttctgcttactatttcttacgaaattttccattcgttttcatatcgcatacgtttcgagaaaccatgcagtaaataataaaaataacaaaatgaaaaaccggttcgagtggaattactcaaacgaaagaaattagcctgtggttcgtgaggctaatattaagccagaacaaatttaagagttgcgcccaaaatagttgctttttgatttcaagggcaaatataatcgttttttatgattatatgacgttttggtgaaatttaaagaacaaggtatccgaaaaagcacaaaaatagtatctttgcctgcgatttattaccaaagatgtgataaagctatttttaatcatttaataataaagactatgattagattaaatgttttcgtccgcgtaagcgagacaaaccgcgaaaaagcgattgaggcagctaaagaactgactgcttgttctttgaaggaagaaggatgcattgcttatgatactttcgaaagcagtacccgtcacgacgttttcatgatttgtgaaacatggcagaatgctgaagtattggcagctcacgagaaatcttctcatttcagcaagtacgtaggtatcattcaggaattagctgaaatgaaactggagaagttcgaattctaaatgaaacacgaagaatagatatactatctatccaactatcatcaaaaagagagagacattcttcttcgaaaggaaagaatgtttctctcttcttatttccagatctcacgggaatagaactgtatgaagtgattagtccagcttcttatgaataaatgtcccttcaatccaataagttgcgtgattcgattcaaatttcagcagcacatagcccggatcggtaggacctccaggaaaatgttcgataaaccagtcctgccaaagttcttgtttcatcttctcgtcggttaccacttccacagttcccgttaaggctacgctgtctcccttatcctgaaaacataatccggctttcgggtttgccagaaagtcaatagtctttaatgagtccgctccggtagacatccaaatagtagaaattccgtctgttgcaatcttactcatcggcacaggacggggatatccctctttatttacagaagcaagcactaccacttcacacctctgcaacaactcggttgctttctctttcattgtttttgttgacataatcttattggatttatattgtaggcaaatatagtgaaaataaattctaattcacaatacgcccgtttgcctttgccttttgaagccattcagggacaatttctttgagaaatttatctttgtccgccttttcaacagccatatccaaaccaatatattgctgtactttttctttcgttgtaatatccggaagtggtacattatctgtatacccatgcgctacaagcactttgctgataagcatacgagcttggaatactttatttaagccatgccccaaaatacgcatggtttcctgcggggcatgaaaagaaccgccatgagaagatacgccgaaatcccatctccactgtgcctgacgaattaacagcaaggcttcttgcatttcattttctgtagctcctatatcccaagtaaacttcgcttcgatatgtgcttttgccaactccttttctaaaagtgtacgcaactcatttgccttttgctgacgttcgtatacatttttacagagcgtctctttattatcacgatgacaagtctgacaagtgcgttcagtcactactaacggattctgaatatggtgatcgctatattttatccctccttcatcattgtaaggcatgtgacagtcagcgcacgacacaccacgctgggcgtgtatgcccatcttgaaaatttcataatcaggatgttgagcctttaatataggggcacggctcaatttatgaatataatcagtaaatccgatttcatcataatacttttctaaatcttcaacagtgaagcccttatcccaaggaaaagtaggatattttatattccccttgaaataatactccgaatgacactgtgcacagaccaatgaacgcatttcctgtggagtagcatgagtgatatctctaccttgacggctaaaagcttcagtgagcgacggacggctgatatgcaaatccatgtttttaggttcatgacaatcggcacatcctatagggtttacaatttcggctccccatgcagcccacttattattataaaaggaatctaccccaatagcttctatcatacggggaacatcagaacttttacacacccagcaacttgcaaattgaggaccgtcagcatcccccataggcgcaccagtacgaagtgaatgaacaatatcctgtaaagcgtacatatgcccgcgcggtgttgaataatccttagaaaaagcatatccagcccataatatgaccatttcaggacgttgcgctaaaacatcgatagaagttcttccatttaatctactgtgcaaatcggtcgatgtcgtatccacccacatcttatattcacgtggatagttttcagcaaaaataatgctgcgtgcttctattccgtttatttttatctttttcttatagtctacatttacaacctctgcgctgtgttccatcaggaatgaaataattactcccgatgcaaaaataacagccattgcaagagcgaatagtacccacctctgccagggtttgaacttacctttcattatttgcttttttcttttaaataccttctgtttattgtactaaattatatttgccaaagacaaaataacggagaaacaacttccttttcctacttctgaatgcacttctatacgtccagccagtcgttcaataatcactttacaaatggaaagtcccaaaccactcccctgctcaaattcatcagtcttgtaaaagcgatcaaaaatcatcattagttctttatcgtcaatccctttgccagtatcttttacgtaaacgcaaacttcctgatgctctttatatattttgcaccccaaagtaatagttccttctttggtaaatttatttgcattattcagaaaattagagatgacttgagtaaaacggaagcagtcgatgttaacgggtaaggaaactgtttcatcaagttcaaggataaagcataatgaaggctgaatcaatgtttggtaagtgacataaatctcctttattattttcgtaatgttatgttcctttatatcaaaggataagttgcctgaatctaaacgagatatttctaatacgtcattcaccagtttcaaaagtaactcattattattattgactatttcaatcatagcagctttctcttccggttctatttcatcagccccctcacctattaataaatttgtgaaacctacaatagcattgagcggtgtacggatttcatgactcatattatttagaaacgactgtttcagctctgctttttctgctatctgtttcgctagaatcaactgttgttcatgctctaccaagttttgaatattctgcataatgcctgccaacataatctccccctgggcatctttcaaggtactgcatcgaagttcataccattgataatctgcctctttccctccaaaacaaaaacgtattcgttgtatttgcatactgggagactgatataatgtttcgtagaatgagctaagcaattgtacatcatcaggatgggtatatctcataatatcctcttttgtaaatctccgttgttccatgccaaccaatcgtacataattatcatcaaattcaagaacaccttcctgaatattccaaagtgaaattttcccgccattcatagaaagagtcaatcgtttatgcgcttcttccagcatttgaagattcttacgctccatcaacgaacggcgatgtgtacgtaacaaactaatggttaccaaaataaaagagaaaacaaacaacccacccaacaaataaagttcttttcgataacaatcgtaaaacggatagttgattatacggacattttgcggaacattactaatatcacccgcatattcagaaaaatatgtccagtccagtacatactctttttctaaatctcttattttaggcattcctattttttctttctttaataagcgtgcagcaaggctagcggaagccttcgccgtaataccctctgtagccatataaccgccgacaatcttagcattttcaccgaaaccttcacgaatacaactaaaagaaggaatatttaaagctgttactatcggaattgccagcatatctaatttatccagtaaaaacgcttgattttgttgtcttctctttgattgtttcaacattactaacaaagaagatccttttatataacgaaaggggcaaagacttattgtcagaccattcttgttaacattatcatttatcaaaccgggggtcagattaaaatattcaatcatctccgtcaaatgcttataatcacactcttgcacaaatgctttttgatagcccaaaactctcacattcttcctgtcaaccactcgggaaaggctatcgaaagatttatgtccaagaaaggtcagatctatattataaataatctccatatcattatggggatacaatgtttttataaagtcgatattacgtttcagatcgggactatcacgcaatacataaactttctgcgaatcgtattcttcaatcagttcttcattgggaaaatgcacattacaagctaccacaggaatagaagataataaccggtgacgggtagataataaagaattagttgcctggtcaccaacggtcagaataaggtctgtcgatttactttctagaaattcaagatattcccttacatgttctatccgctctttctcatcatatttgctacaatcaaaataaaacttatcaaacattacctctatcccttgtttctgaaactcctgatacaacaacttttctatatttctgttgccaatatcatctttagatatggagtaaatcagggaaatacgctttaccatcaaattgtcagtaacataccagtgtttgtaatttagtccacctataaaaacaagcaatgaaagaatgaatattaaaacgtatttatatttgaagtaggttttgttcatgcttttttgtttatgtttggcaaaaatagcataattttcacaacaagaaaggtatttcactgaaaacatccattaaaaacattcattttcattaaaatcaataaatttcctggttatcaatcctatttctatattttgcatgacccttttttgtattatctttgtttctctaaaacaaggaaataaatgaggaactttgcagccatcgactttgaaacagccaatggtaaacgtacaagtgtttgtagtgtaggtgttgtcattgtaaaagacggtaagatcgtgaataaaatctatcgtctcattcgtcctgctcctaattattatacgcaatggacaacggctatccacggattaacttatgacgatacgatggaagccgaagattttcctgatgtatgggctgaaatcaaaccgttgatagatggattgccacttgttgcacacaatagtccttttgatgaaggttgtcttcgggcagttcacgaattgtatgacatgacttatcctaattacaaattttattgtacctgccgtacttccagaaaagttttcggaaaagatctgcccaatcatcaattgcatacggtagcagaacggtgcggatataatttagagaatcaccaccacgcacttgctgacgcagaagcttgtgcacaaatagctttgcttattatccccgatcctcccaaaccgaagaaagcaaaaaaagccgataaagatacgcatgttggagacttattcgcctcacttatccctcaacaagtgaaaaagaataaataaaaaacactacaactattatcacgatcaataatagtcatagtgtttttataataaagtgctaattaaaacttcaactaaaggatagacttagcgatacccatttccaagccgcgaagttctgccagtccgcgaagacgtcccagacaagaatatcccggatttgtcttctttttcaagtcatcaatcatttgatgtccgtggtcgggacgcatagcgatagagcatttacgacgttgttgcaaaagaataagagctttcattacgccgtacatatctacatttccttccaagtggttagcttcatagaagttgccttcttcgtcacgctgtgtactacgcaggtgaacaaagtttacacgatcaccgaaacgttccatcatgcctgcaaggtcattgtcggcacgcactccgaaagaacctgtacacaagcaaaggccattggattcgttaggcacggcttcaatcagttttttgaaatcttcttccgtactcaaaatgcgtggcaaacctaaaatagtgtaaggaggatcatccgggtgaataaccagcttcacgcctacttcatcggcaacaggcgcaatttcttttaagaagaaaatcaagttggaacggagcttttcagcgtcaatatcattataacggtctaatgcctgctggaattgttctacagtgaaactttcttccgagcctggaagtccggcaatcatattgcgaaccaacagtttcttatcatcttcactcatttgttcgaaacgagcttttgctttagctatttcttcaggagtataatctttttctgcgttcggacgtttcaggatgaaaagatcaaaggctacaaaagccgccttttcgaaacgaagagctttagagccatcaggcattgtataggcaaggtcagtacgtgtccagtccagtacgggcataaagttataagtaactaccattacgccacacttcgccagattacggatactttccttatagttttcaatgtatttcatgaagtcaccagtctgtgtcttgatatgttcgtgtacaggtacactttctaccacagaccatgtcagacctacttcttcaatcatttgtttacgtttcatgatctcttctactgtccacacttcaccattcggaatgtgatgaagagcatttactataccggtagcgcctgcctgcttaatatcccacaagctaacggggtcgttaggaccataccagcgccaagtttgttcacataaatacatattgttattaaattaagaattaaaaattgagaattaagaaatcaaagttgaaaattaaaagttgagagtcggcatacggatgctacgcagccaattctcaatttttaattctcaattctccatttattaaattgagaatgcatcaaatccaccatcgattacagctactgtacctgttacgaagttggaagcatcgctaatcaaataatggatggttccataaagatcttccggttcaccgaaacggttgaatggagtatgagcgagaattgtttttgaacgatcagtcagagagccatccggattagtcaataacgcacggttctgatcggtcaggaagaatcccggagcgatcgcatttacacgcagaccgttaccgaatttcaatgccagttcaccagccatgtatttagtaaagttagcaatagctgctttagctgcaccataaccaacgacacgagtcaatggacgaagagctgattcagagcagaagtttacaatagaacctttcttctgttctaccataatttcagcaaataccatcgtaggcaatacggtaccgaaaaggttcaaatccaccactttcttaaatgcgtcaatctgtaaatcgaagaacgttttgtccggagcgatagttgcacctgccatgttacctccagcagcgttcaacaaaacatcaatacggccataagccttcattatttccactttgttaccttccagcacttccttatccatcacatcagtgtaaaggaacattgcttcatttccttctgctttgatactgtctaccaatgcttttccagcttcttcacttctgtcgagcacaaccacttttgcgccttcctttgcgagatacgcagcaatacctttacctaaaataccagctccgccggtgataacaactactttgccttttacgttaaataattcattcatggttcttataaatttatatgtttataatttattgttcagataatatttcaaattctctttaaggagaatatcgataggcatcaaattcactttctcactattctgcttgaacagcaaatgattacacaatgatttaacgccatcgtacccctgacgctcggggcgctgcgcaatcaatgcggttatcacaccttcggaaagtaattgcgtatttctgccgataagatcataaccaaccagtttgacagcctgcattcctcttgctttcaggtaatttcctaaaatatagcaagttgaattaaagataatagcgcctttaatattcggattagcttcaaagatttcatccagtttcatgaagttatacactgaatcatttattttcagttctacttcatgcagatttccgttaaaccctatttcagtgagataatgacagaaaccttcgcgcctgttctttccctggttagaatcattcttcccactatgaataatccgtgccattaatatatcggaagaagaaggaagcctgtccatcaataatctggcagcaatcactccggcatcataagattccgttccaaaataagccagttgatgctgccctccaatgttggagtcaacatacacgtatggtatttcattcctgtcaagctcctgcgaaagccggataacagaatctgtaaacaaagtcgcaatcaataccccatccactttctcattcagcagatttcggatgatatcatcaaaagtcttattattatattgatcgaaaaagagtttggtaatggtgatattatatgattccatttccgccgcagctttatctatcccttccgaaatagcttcccaatactccccttgcacaaaagaaggagttattgcaaggatatgatattgttttttggaggcagctaatgaacgtgccatcagatttggttggtaatgtaccatttccaggatagcctgtacttttttcctgttttcttcagatactcttccacgattatggattacacggtctaccgtgccaacagagacacctgccatcttggcaatgtctacaatccgaatatttgaaaactctttatccatatattgataagtatcttgtttttcatcggcaaaagtaaaatgaattattgaattaagcaatagtgtgtgcgcacacacatcatatcaaaacaagtatatacaactaataatcaaataattaactccaacaaacagaaaacatacatgttgttaaacataagaaaaagtaaagatggtatagagaaaaagactcttttcagatgaaaagttagagagaaagtaactcccaattcttgaaggaaacgagaataataaagaagattagcctaaatgtgttcgcacacacattgatacgatgactaaataaagctagggataaaagattaaatatacaaaaataaaacaggtaaccaattatatttaaatcgattacccgttttgggattcttacttttcccacttatcttttgcttttccggccactttgtcggcttctgccgctactttatcagcaatttccgcaccggtttctactgctttaagtccaagatccattgcttttctttcagcatgagcagctgctatttcagcatcgcgacctatacgatggatagcattataaatttcgctttccaactgttttgcttttgctgtacgtgaaagacgataagctactgcgccgaggattgacccaattccgagtccaatccagaaatttccatgtctacattccataattaagttctgtttttaggattaaaaataaattatataaatatctatttagatttcgagaataaggaagcaatccataatacaaggatagcccctacagtggaagttatcaaacttccgatcaatcctgaagctgacagtccgaaaagggcaaatacccaaccgcccagtacgcctccaagaataccaagtaataaatttataataagaccaaagcctccgccgcgcattactttacctgcgaggaatccagccacaataccaataatgatataccaaataaagcccatataatcctccttttttatttaacaacagcaggtacggagaatagttcagttagtcaaaattgaattaacgacaatttagaatccttagtcttagagaaacgggaaagtttgcgtacctttgcagccaatttttcaggaacacttctaaagcaataggtatcatggtacaaaatcaggaacaacccgtaggaaaaattacattttccatcttaatcgcattaagtctttcacactgtctcaatgatcttttacagtccgttgtttcagcagcttatccgctattcaaagatgatttaggattaagttttgcgcaaatcggccttatcacactggtttatcagctttcggcttcggtctttcaaccgattaccggaatcatttttgataaatatcccgttgcatggtcgttgcctatcggaatgagctttacactgattggtttgataaacttagcattctctgataatctatactggatattagcctccgtattcttaatcggaattggctcttccgtactacatccggaagcctcccgtatcacattccttgcctccggcgggaaacgtggactagcacaatcgctctttcaggtaggtggtaacttcggaggttcattaggtcctttactggttgctctgttggtggctccttatggcagacaacatctcatcgtatttgcatttgtggctttagctgctatcggagtgatgtacccaatttgcaaatggtataaatcatatctaaaccggatgaaagcacagaccgtcagtgtcagaaaacctgttcatcttcctttgcctatggataagacagccctttcaatcgcgatattgctgattctgattttctccaaatatatctatatggcaagtctcacgagttattatactttctacttgattcataaatttaatgtaagcgtacaagattcgcaactatatttatttatctttctggtagctactgctatcggaacattaattggtggacctgtcggtgaccgaattggtcggaagtatgtgatttgggcttctattttaggagctgccccatttagcttactaatgccccatgccaatctgctgtggactattatccttagcttctgtgtgggattgatgctttcttccgcttttcctgccatattgctttatgcccaagagttgcttcctaccaaacttggattgatatccggcttgttctttggatttgctttcggagtggccggtgtagcatctgccgtactcggtaatttagcggataaaacgagcattgaatatgtatataatatctgtgcttatatgccgttactaggattggtcacattctttttaccgaatttgaagaagaaaaaaatagaataagattagattaaataaaatggggtgtgtcacattttgcgctccctcttttccaaagaaaacgaccggtatgcatcgtcacgacgtataccggtctacaagttaaggtcaaagtcaaaaaattaagagagctatttatatgttagggttagcgttaatttctttctgtggaatagcatataaataataggtgctatttactgtaaacggtttaccgttcgggaagttgaggaaccaatgtcccagaggatttcgtttttcaaagctaccaccctcctgccagcaatcgacttctgtcttttgcatctcatccgacaaagcaacacgttctactgccttttgtgtacgaagtatatcggtaataccaaatccttctccccaaagttcacgacgacgttccatcagtatctcattgattacatcttcctgtgattttcctgtcacctcataatcccctactccacgggcattacgcaatgtattcaatggagctacagcctgtgccaacgctacgccgtcacgaactttcgcctccgcttctatcaaatacatttcagcagcacgcatcaagaccagatcagccgtatcatctgcacgcatgtgaaatttcttatatcccaaatacccttcacgcatccactgaaacaaaggtaaacgaatatcaccttcggtaaatgtatctttcagatggggatcagccataaagctgctatatgctcctacgtatgttgcatccaaataatagaaattatagctggcatccgattgggaaggaatttgaggaaatccccatatccattctttattggaaatattattaaaaccttcgtactcggctgtagttgtcatcaacgtatatcctgcacgtgctgcttcggcagcttttgcggcttcttcccattgtccggtcagcaagtaagcgcgagccaaaagaccgtcaaccactgcaacattcggtttgaacttttgattatcaccgctgcggacatagtttttcaaatagtccttcgccaaagtgagatcgtcgaaaataagctgataaacctgtgccactgttgattttcctttcggtacagtggaactattgctaggttcggtatatataggaacacacggagcatctttatctttcaagtaggtgaattgataatgctgtaccaagtgcaaataacaaaaggcgcgtaatgccaatgcttgtccctgtgcctgacggagttcttccgaatcccccttgatagaaatggcagtgttacaattatctatcgttttatatatcagataccaggcaaactctgttctaccatttgaggattgcgctatatcattaaactgatacgaagagttaaaaccatatttcggacgggaaacaatatcacttgccatcatatcatccagacactgaagtgcccgataaccgatattggcataggtacttgaataatcaaacagattataccaggcaccattcacaagtgcctccgcattttcgggtacagataccttatccgaacttaccgcatctgtggggtccgtatccaaaaaactgctgctacaactcgttgccaggaaaagtccggcaactgccgcaagaatggattgaatttttatttttctcataatttagtctgaatttagaaagaaacattgatacctccggagatggttcgcatagccggataacggtaataagtgataccggtaattccctgttcagggtctagtccctgattccggtgaatggtaaacagattatctccttgtacatatacctgcacactgctcaatgacaacttactaatccattgtttgggtaagttataggaaagtgtcaggtttttcaatcgcatatacgaattattctgcaagaagcgagtggaagccgagttccagttattagaagtagtactcaaagcagggacatcggtatagcgattgtcgggagtccatcttcttagaatctccgtcgaccagtcgcgaccctccaaacttccattgtgcagaatcattgtaacatcacgattgtagatatatccaccgatactgtaagcaaagatagccgaaagatcaaatcctttccaagaaagagacgtattgaatccgccatatactttcggaagagacgatttgttgacataataatagtcagccgaaccataatcatttgttgtgacacgttttccggtcggattcttatttgcatccacctcatccttataccacagcggatctccattttccggatctactcctgcccactctatcatatagaaatcatacaccgaacgacctacctgcaacttgttcacaccacttcgcggcatatctttcaatgggaggtctgtcaccttattcttataatgcgtcaagttcatacccagtttccatacccaaccattctgattgataatcgttccgttaagcaccatttctatacctgtattcttcaaggctcctacattttcgtcaatagaaccatatcccagggaaggagctatcggacgtgaataaagcaggtctttcgaacgacgtgtaaagaaatcaaatgaaccggaaaaacgattattaaacagggagaagtcgatacctacattaaagttgaggttcgtttcccatttcagattcggagtcgccatacggtcggacactaacgcattttctcccaaattggaaacaatggtataaagtcctttactcgcataataagtacctaggttatcatttccctgcgcaccatagctcattttcagagtcaaggcagaaagccagtcggaagtacttgccataaactcttcccggtcgatacgccaggaagtacccaacgaccagaaatttccccagcgggtctccggcgcaaaacgtgaagaaccgtcgcgacgataggatgccgagaagaaatatttattttgatagtcgtataatgcttgagtcagataacccaccaacgcatagtcgatgcgataccccgaacctccggtcaactgtgaaccaactactagttccggcatatcaggctgcgccattttggaacgtgatgccgtcagttcatcgtagcggtaggaataggcctccacgccggcaagaacattaaaatgatgttcaccaattgtcttgtcatacgtagcaatattattccatgtccaagagaaagtacgggtattcattcggctgacaccgccgccgttttctttagccggacctaattgggggttcgtataatccaacgtattataattaatcaagtcaaagttgaaactagtcttgaatttcaatccctcaataatcgtagcttccaagaaagtacgaccggagacttcatctttcattcgttctgatttatccaaaggcaaagtagccggcagattccagtttgccatcgaaccggaaggacgataagagccgaagtcataaatgcggtctccattctcatccaatttgtaactaccgtcggtattcatttcataaatcggataaaatcccggcatggtacgtcctgcagtaatcacattactggttttggagtcagaagaaaccggatagttctgcatagaatgtgcaaaactcaaattgactcctcccttcaaccaggaagtcatttcgctggtgatattggaacgaagattgaaacgctgataacccgattcaagcgcaatacctttatcattcaggtagccggctgaaaagaaatactgatttgcttttccgcctccggaaacacttagattcaactctgtacgaagtgcctgttgttccatggcgtcactccagtctgaattccataatggacgggcacctgccaccaattttccatctgtaccgaccggttgcgtatattggggaccgtatggattggggccacctcccatcaatttcgtaaccaggtctttggatgcttgtgccgcagcagttgccggagtataatccgcgctcttggcgtactgattgcgaagtgcttcccaatacaattcaaagtattgatcggtactgacgcgatcataatcacgcacggcacgattggaacctcctaaagaggcttttacctttacggtcgctttggtattttgatctccttgcttggttgtgataataatcactccatttgcgccacgtgaaccgtataaagcagcagaagccgcatctttcaatactgtcatcgaagatatatcatcaggattgatagagttcacactaccgtcgaacggaacaccgtccaccacataaagcggagcactggatgcattgatagatccgataccacgaatacggatttccgcatccgtacccggctgcccgcttgccgcactagcctgcactccggacaccgtcccttctaatacgcgcgatacgctcgaagtctgtagcttttcaatctcacctgctttcatcgtcgaagctgctccggtaaaactatacttcttagcggtagcataagctactaccattacttcttccagttctttactttccgattccaacgtgacattaatcacacttcggttattcaccggttgctctaccgatctcattcctacaaagcggaacactaaagtgccggtagcaggaacttcaattgaataatttccatcaatatcagtgatggtgccggaggatgctcctttcaattgtacggagacaccaggcaagggctccccttcagaagtcaccgtacccgtcacgcgtttctcctgctgtgcttccgcatatactatatttcctgcaaaaagcagaagagacacgactaataaacgtaaatagattctcataattttgtggcttaagatttatttgcttgttgtaactaacagtatattgaacttttttgtttaggaaacgaaacattttttagaagattactagcataaatcaacgaaaggtagtacattcgtgaaacgaaaaacatctaaaacaacaaagaaccacatggggaaacgggttattctatatctatttctgttattttcactgtccttacaggcgcaaagtgaaaagaaaaccctttctacaaatgatagcacaagaatagattccacaacggtcacccagcccagtcctttcaaaagagcaatcaagaaatttatgaatttcagtgattttgatacgctctatatcagcccgaaccgttataattatgcgttgatggctactcatttcagcaacttcgaatattactctgtcaccagcgaacagcctcaaccacaaaaacttagtttctctcctaacccgcataataaaataggactgtatttcggctggcgatggattttcctgggatggtccgtagatgtggatgatatctatcggaaaaccaaccggaagaatagaggtacagaatttgaccttagcttatatagttccaaacttggtgtagatatattctaccgccgtaccggaaacaattacaagatacataagatcagaggattttctgaagatattccctccaactattccgaggatttcagtggaataaaggtggatataaaagggctgaacttatattatatcttcaataacagaaaattctcttatccggccgccttcagccagtccaccaaccaacgacgcaacgcgggaacatttattgccggtttttctatttcaaagcatcatctcgacttcgactacacagaacttcctgattttctacagcagacaatgaatcccggtatgaaagtcaaggatataaaatataccaatgccaatatcagtttcggatatgcctacaactgggtctttgcccgcaactgcctggcatgtttgtctctcacccctgccattgcctataaagcctctgatgtagatgcggaaactcacgaaggaaaagcatggtacggcaaatttaatctggattttctactccgtgcaggggttgtttataataacggaaaatactttgtaggtacttctttcgttgggaaaaactataattaccaccggaataatttctctgtagacaatggtttcggcactcttcagatatatgccggattcaatttcaacttacgcaaagaatacaggaaaaagaaataaaagtacggatatcagaaatcgtaaacttgcttgcttatccaaagaatctttgtacatttgccacgttctaacgaacaaaagtaaaaaatcaatgaagcaacaacgccacatacagaccacacgtactcttctttcccgcttccgttattggggcagaaagaactatgccgcttttgcgagtatgggacgtgaattccaaatcggtcatctgcacatcaatgttgtggacgttgcccttcgcaagcagaatgctaaaattactatcccttatcatacatttatgacacttcaggaaataaaagaccaagtgttggcaggcattgatatttcgcccgaccaagccgcttggctagccaacatggctgacagcgaggcgctatatgccgccgcacatgagattaccgtcgcacgtgcttcgcacgaattcgacatgtgttccatcatcaacgccaagtccggccgatgcccggaaaactgtaaatggtgtgcacaatcctctcactacaagactaaagccgatatttacgatctccttcccgctgaagaatgtctccgacaggcgaaatacaatgaagcccaagacgtcaaccgtttctctctcgttaccagcggacgaaaaccatctcccaaacagatcacccaactttgcgataccgttcgccaaatgcgacgtcactcgtccattcagctctgtgcttctctggggttacttaacgaagaagagctacgttccctatacgaagccggaatcacccgttatcactgtaacctggaaacggctccgtcttatttttccaaactctgtactacgcatacacaagaacaaaaacgagctactcttgatgcagcccgccgtgtaggcatggatatctgctgcggaggtatcatcggtatgggagaaacgatggagcaacggattgaatttgctttcactttaaaagaactgaatgttcagtccatacctatcaacctgcttagtccgattccgggaactccactggaaaacgagcagcctttaagcgaagaagaaatacttaaaaccatcgctatctttcgttttattaatccgacagcttttctaagatttgccggaggacgttcacaactttcttccgaggcgatgcacaaagcattatatatcggtattaactcggctatcgtaggcgacctgctgacaactctcggttccaaagtatcggaagacaaaaagatgattcaggaagaaggttatcatttcgccgcttcccaatttgaccgcgaacatatctggcatccgtacacttctaccaccgatccgcttcctgtctacaaagtgaaacgggcagacggtgttaccattaccctcgaagacggacaaacgctcattgacggaatgtcttcctggtggtgtgcagtgcatggatataatcatccggtattgaatcaggcggcaaaagaacaattagataaaatgtctcatgtcatgttcggaggactgacgcatgatccggccattgaattggggaaactattattgcctttggttccttcctccatgcagaaaatattctatgcagactccggttcggtagccgtagaagtggcactgaaaatggctgtacaatattggtatgcagcaggaaaaccggaaaagaacaatttcgtgactatccgttccggctatcacggtgatacgtggaatgccatgtctgtatgtgatccggtgacgggtatgcacagtcttttcggttcagcattgcctgtacgttattttgtcccgtcccccacttcccggttcgacggagaatggaatccggaagatatactgcctctgcaagagataattgaaaaacattcaaaagagttagcggcgcttatcctggaaccggtggtacaaggagcaggtggaatgtggttttatcatccgcagtatctgcatgaagcagaaaagctttgccggaagcacgatattcttctaatcttcgatgaaatagcaacgggattcggacgtaccggcaaactttttgcttgggaacacgccggagtagaaccggatatcatgtgcatcggcaaagcactgaccggaggatatatgacactttctgctgtattagccagtaaccggatagcagataccatctccaaccatgcaccgggagcttttatgcacgggcctacatttatgggtaatccacttgcgtgtgcagtagcttgcgcttccgttcgcctattactcgaatccgattggcaagagaatgtgaagcgaatcgaaactcaactgaaagaagaactggcacctgcacgggaatttccggaagtagctgatgtacgaatactcggagctatcggagtcattgagatgaagcgtccggtaaatatggcctatatgcaacgacgatttgtggaagaaagaatctgggtacgtccctttggcaaactggtatatctgatgccgcctttcatcattacttcggaacaattaggcaaactgacttccgggctacttaaagtcattcaaaaaagatgacagataagaagaatattaccggattttcacccaaggatctgttcctcggtgagcaaaagggtgttcctcggtgagcaaaagggtgttcctcggtgagcaaaagggtgttcctcggtgagcaaaagggtgttcctcggtgagcaaaagggtgttcctcggtgagcaaaagggtgttcctcggtgagcaaaagggtgttcctcggtgaggaacggacctttcctcaccgaggaaggatgccttggtcggtgagaaacttccgggatagtccttctgacgataaacatcttataaacaacagattacactttcaatcattcatctatcgaatactgattacttaaaataacaattcatgacattagagtatataaaccaagaactccagaccttgaaagagaaaaagaactaccgttctctcccaccgctaatccacgaggggcgagatgttctgctgaacagacaacgaatgttgaacctatcttctaatgattatctcggactggccaatgacatttcattgagggaggaattcttaaggacgctcactcccgaaactttcctgcctacctcctcttcttcccggttattgaccggtaattttagtgactatcagaagttggagcaacagctagccaccatgttcggaaccgaaagtgcactcatattcaatagtggttatcatgccaatacaggaatacttcctgccatttgcaacactcacaccctgattcttgctgacaagctggtgcatgcaagcctgatagacggaattaaattatcatcagctaaatgtatccggtatcgtcacaatgatatttcccagttgcagcgactgattgctgaaaatcataacgcttatgagcagattattattgttaccgaaagcatcttcagcatggatggcgatgaagctgatcttcccgctctcattcaactcaagaagagctattccaatattcttctttatatagatgaggctcatgcttttggtgtacgagggaaaaaaggattaggatgtgctgaagaacaagaatgtatcaacgatatagactttctaataggtacattcgggaaagccattgcctcggcaggagcgtatattgtctgccggcaactcattcgggaatatctaatcaataaaatgcgcacgtttatattcacaaccgctcttccacctatcaatattcagtggacttcatgggtgttagaacgtcttccagctttacaacagaagagaactcacctgctacaaatcagtgaaaagctgaaggaagcccttacaaccaaaggatacaattgcccctcggtaagccatattgtccctatgattgtcggagcaagtgaaaataccatattgaaagcagaagaactccaacgcaaaggattttacgcattgccggtacgtccgcctaccgtacccgaagggacttcacgcatccgcttctcactgacagcggacatcaccgaacatgaaatcgaccaactcattaaactgataaacggatgaaacagtattttatcataaagaataatcaaaagcatctattgcttttcttcgcaggctggggaatggatgaaactccattcctgcaaattcacccgaccgataaggactggatgatttgctatgattatcgttcattagagttcgatgccgacattttgcaagaatattccgaaatcaccctcattgcctggtcaatgggagtatgggcagcctcacagataatgaaacaatatccatccctgcccctttcccaaagtatcgctatcaatgggactctttatcccatacatgagacgaaagggattactcctaccatttttgaaggaaccctgcaaggactgaatgaacaatccctgcaaaagtttcaaagaagaatgtgcggttcagcagccgattacaaggcttttcagacagtagctccccaacgtcccgttgaagagctcaaagaagagcttgctgccatacaaaagcaatacttatcattgccaccgtcggattttgcatggcaaagagccatcataggaaagagcgaccgtatcttcctgccggatagccaatggttggcatggagaaaccaagtggattcccttgaatatatagaagccgctcattatcaacaagacctttttgatagtgtaatcatgcaaatcaactaatgatcgatttatggataaacaactaatcgccgaacgtttctctaaagccattgctacttatccccaggaagcaaacgtacagcggcagatagcagataaaatgattcacctgcttacaaaacacatctcttttccctgttcaaaagtgattgagttcggatgcggcacaggtatttattcccgtatgctacttcaggcccttcggccgaaagaattattgctaaacgacctttgcccggaaatgaagtactgttgcgaggatatattaagaaaagaacaggtttcctttcttccgggagatgcagaaacagttcctttccccgctgaaagtacattaattacttcctgctcggctctgcaatggttcgaatctcctgaaaactttttcaaaaggtgcaacgccctgcttaatagccaaggctatttcgctttcagcactttcggtaaagagaatatgaaagagatacgagagttaacaggaaacggactcccttatcgttcacgtgaagagcttgtgacagtcttgtcatcccactttgacatactccattcggaagaagaacttatttctctttcgtttgataaccccataaaagtactttatcatttgaagcagacaggagtaaccggaatatccggcacctcttcccaacaactgcggacacgtcgtgacttgcagttattcagtgaacgttacacacaagaatttacccaaggcacttcagtgtccctgacctatcaccctatttatatcatcgcaaaaaagaaaaaagtatgaaacagaatgtatatttcgtaagcggtatcgacaccgatgccggcaagagctatgccaccggatttctagctcgtgaatggaacaagaacggacagcgtaccatcactcaaaagtttatccaaacaggaaacatcggtcactccgaggatattgatttgcatcgtcgtatcatgggaatcccctttacagaagaagacaaagaaggactgactatgccggaaattttctcttaccccgcctctcctcatctagcttcccaactggataaccgccccattgacttcgacaaaatcaaacgtgctacggaagagttaagtgaacgctatgattctgttctgctcgaaggtgcaggcggcttaatggttccgctaacaacagaacttctgacaatagactacattgcccaagagaattatccgcttatctttgttacttccggtaaattgggaagcatcaatcatactttgcttagccttgaagccatacaaaaacgaggtattgtactggatacagtactttataatatgtatcctaccgtaaaagataaaacgattcagaatgatacgatgaacttcattcaaaactggctgaagaagtatttcccggatacgaaatttatattagttccggaaataaaagaataaaaagacttatgacttcaaaagactagcctcactatttgccgggctagttttttgtttctacaatccacttttcaatattacgggtttccgcactgaaatttactcctattttaaagagtttacgtccgtccatttcgaaaggaagagcataattcttgtcgttaatctgctgtaaagcatcttctgccgtaccgttcaacttaaattccatgatataaataaatttatcggtctgcaagacaagatcaatgcgcccttcactcgtatgatactctaccttggtgtagaaacctagcagtttaaaaacgataaaaagaacattttcgtaatgtagctcctggtcccgaatcacttcgtaagtagtgtctgcaaagaaactttgcagacggcggaagaaagagttataatcaccggaacgcacttcacgaacaaacttctgaatctcaaaaggcgactcgaccttatttacgttcgcataaaaaggaagcaggaagcggataaaaccttcttccacttcgcgattggggaaacccaagcgatacattccaaattcttcatcataccccttaatggttaggtatccactctgataaattaccgggatgggattggtggattcagaatctatactgttcaacacttggacatcggtctcttcatgtgccatccgctccaggtcataatgatgtttttttagcaatttcaccaaataggtaggcgtacccgtttcaaaccaataactaccaaactccttacgcttgaaagcgttcagcagactgaacgggttgtacatgccgattgaattgtgcgtaaaatgataaccgtcataacactctctcaaatcttcacagagtttgtcatacgttattccacgtgctgctgcaaattcatgtagttccgcttccagattttcatggatttcacgctcgctgacaccacaaatttcgacatactcattccacattgaaatatcatccagattattcaaatcactgaatacactgactttgccaaactttgtcacgccggtgagcagagcgaactttatatacccgtccttcgttttcaaagcgccataaaatggcttcagagtatttcggaattgcttttgcagttcctcattaccgatagcttgcagcataggtttgtcatactcatctaccagaataactacacgttgtccggtcttctcacaagcacgctgaatgatacctgcaaaacgcagggaaaaagatgtctcggatggacgggtgccgtattggctttcccaatattccagattatcattcaatatcttatccagactttccggagtgtcatacttctcgatattcaggtcgagatgcaatataggatatttaatccaatccttttccaacttttctactgccaagccggtaaacagttctttttttccttgaaagtaagcctctaaagtagaaatgagcagactctttccgaaacggcgcggacgactcaaaaagtaataacgcccggtctttaccatttgatacatcaatgccgttttatcaatataaaaataaccatcctgacgaaggctttcaaaattctgaataccgataggataaattttattgctcataatctcttcttttaaaaatcaacaacacataagtgaagcaagcggattcaaaatccactgggacggttcaccttccttatatagattcccactctttatctcttattaattcttgaatactatttatgaaagtctctgcttgtggatataagttgtttaccatttcttcgtcacaatatacaaagtcatcataatctccactatgccttttctcaaataatgtagaaaaagtttttcctacttttacaggaagttttcctgtcgaaataaagtgcagaccaagcatcgtcttcaccccattatgagtctgcgtttgaatatcatattttaaaagaagagctacagttgcataatagcatgcataatacagcctgttaatagcagcattatagaatgactcacgtatcataacctcagcctctctcaatgtttcataagcacgttgtatccgataagcgaccagtgctttcttactttccttatctagaatttctttcataagacaataccttcgtttatcacatttacataaaaaggtgttttaaaaggccggttctcccaaaatttcttcaaaacaactatcgggctaatactaacacctgttttcaattccaattcatataaaggtaatgtgatagcttcttctttagccaatgtcattttatcaccttccactaaaatgagtaaatcaacatcactatcatgcctggcatccccacgcgcctcagagccatataaaataacctgcgcattgggagcaacacgttttaatgtttcacgaatagcttctataatctccggtctcttcatttcttactctttctaaatgcatgaatgaatcaaacttactacattacaaagatacatttttctatctaaacaacatcacatcttacatgaaagttcgccataaaatcatttaaagtaggtttccgttctctgttcaatctgctccattcaatcggatttgcaatccgattgcttgagtatcaggatttgtaatccgctccttaacctcttgccttcctaaactacaatcacctctagcagtcctttatcacccgcataactcaccgccgaactatataaataatcttcctgccgtgcaacaatctcctgcttcaccggattattatgaatataattcaatttttgcagaaagaagtcatgcaaataaattaattcgggatgattaccttcttgccaaaaacgatacttagatatttttttgtcattagctccggcaaagcgaaaacgatccaacatccattcgcgacgactttcttgaggatctgtttcgagttctgccataatacgtttactagtgaactttttaaaatctcgaaggatatccgaaactgttgcttctgttccggaactgacaatcatgtgcaaatggttactcattaatacccaggcataaattcttaagccttttttctcctgacaataggctagtgactccagaattatatgcttgtatttaggacgggtaaagatatctatccaatcgacaacggtagaagtaacaaaatataattcatctaaaactcgattcgcagtatccattgatatactaatttgattagagaggataaatgtacgattaaaatcgaaagagacaaaggtttttaaacgatcggacacgacaagcggactaaaaatcctgatacaaaagaccagcggattataaatccgctggaaccttcttatatatctgctgcgtaagcgcgtaatggtagaacattctacaattattcactgattttgcgggcttttctcttctgtcgcatctattcattaaacaatagtcgaatatttatccaaagcctttctcaaagttctttccgaaaccggtttagtcacaaaatcattgcatcccatctccaaagccaattctttatccgtttcaaaagcataagccgtcaaagcaataataggaatatctttggaataagaacgaatgatatgcgttgcttccaatccatccatgcgtggcatttttatatccatcagaattaagtccggttgatactgcttatacatttcaatggcttccaccccatccttagcccaaagcaatgtatattccctgccgatcagattcttcagcaggatgaaattactttctacatcttccgctaccaaaatctttttgatctgttgcacacgatttacagtatctcctttagattccgtctttgacattttaaagatttcgccgagttctccggcttcttcataaggaatcgtgaaatagaacgtagagcctttacccaattcagaagtcactcctatttctccaccgatcttttcgataatcatctgacagatagatagccctaatcctgtgccttgagcaaaagagttcagtttgacaaaacgctcgaagatatgatctaccttttccggttctattcctattcctgtatccttcacatatacacgaatatttttatccgtccgctcaaaacccaaacgaatctctcctgcatacgtaaatttactcgcattagtcaggaaattcgttatcacctgcatgatacgattctgatctccctcaatgaataaattctcatcctcattatcaaaaacaagagttaccccttctttcacacgttctttatgaacagcataaattgtccggcaaacttctcccagattcattggacgcttgatatattccagtgtcccggcttctatcttcgataaatccagaatatcattaatcagttgcaacaaaatatccgaattctgattgataatacccgaatagagctttttctcttcagcagtttcggcagcaggcaataattgagagaatcctacaattgcattcaggggtgtccggatctcatgactcatattagcaaggaaagcacttttcaatcggtcggattgctccgccttaatccttgcctttatcagttcctgctcaatattctgaagattagtaatatcccaagagataccaatctgcaacggtttgcgtccttccatcggcacaagcgcctttaacgtctgtacaatacgcgctttcccggtgacggaaagatacgtttcctgcatatcaatacgcttatgggtctgaagtaattccaaatcatccttacggaatttctctgcgtctccatgactcggaaatacttcatagtccgtatgtccaatcgctttagacgccgggatacctgaatggtcggcaaatgctttgttccaatacaaatacctaaaatcattttccgggtctttcacaaacagatagactgggatattattcaaaataccatccagcaatagatttagttcgcgaagttcatcctgtttctttataacatcagtaatatcctgtgtaaagaaccaagtcagttcttcattattctcacgaatcagaaatgtagacacctgatgcatccgctctttatcttcacctttccgcatataggcagcacgataagcaaaagtgccatcattgtcacgtatttcctgaagacgtctttcccacgcctcctttgttgtcatagagacgggcaaatcatatatcttttggatacccatctgttgggtaactccgtattcttctataaattgcttatttgcataaaccaatgtcccgtcttccgatacggcaagaatgctgtcactcactttatcgagtacactcttgaaaacctccagttgcctttgcgtggtcacccgctccgttatatcacggcacataatcaatacatactcctcatccaacggaaagatacgattttcgtaatgatgatgttcgccattaaaatccaattcatgatgggcggttgaaacagctcccgtgctgacagcctgacgcatattggagtgaatattctgatatgcttccggtggaaccatttcccgcatatacattcccttaaaatctttatttgatatcccgacatgattggtttcttcattggaaacaacttcaatgcctacttcgttctgattgaagacagtcagcatatccggcaaagagtccagaatcctgacagcatatttttctttgaaactcaggggacgattacttatattctcattcctaagaatagaaagctcctttttgagctgctcattttctttctttagcgcttccagctgttctaatagtactttttggttttgttcggtgttcatgatatatcagaattaatgcgtacttatctgccaaaagtaaatctttttttgaagataagtacgcaaaaaccagtttttttttgagaatcattcaattaccatgatccggtcgttcaatcccaccttcatgccatcttccacaaatacctctttaactactccatccgtcaccgaacgtatctcattctccatcttcattgccaccaatacgcaaagcggatcgccacgtttcacactatctcctttctttacatacgtcttcagtattactcccggcatcggtgcctgtactacctgacgtcctacagactcagcagcagtgcgggcattatgtatcttctccatttctccctgcaattcaatctgataaagctcccctttattcatgattgtatatgaattattggaagagggagaaatctgcactccatgcgagtggtgatcgatgataattgaatggatagagtcgccacccatgttataatcgacctcatatatcttaccattgactgcaatcttcttgattggtccgtcctccagtatttccaccttatattcactatccggcatgtcctggagcttggcgtaatatgtagctaatgttgtacccataatctgttctgttattttttagtcttacatcaataattattagcagtcatctgcaacttaccataatacttccagagcgattcgcctaccaccggaagcgttgtggcacgggaagccgcttctttctcccgttcgtagtgtctcactgcggcagcaatgacagccactgtcggatcggtattctgacggcgtttcagatcttccttatcaaagcgcgtatcaataaacgttgtatcatattcgcctttcaggaaagctgcattcttcaatacacgttgatggaaaggaattgttgttttaattcccaaaatcttatactcgcgcaaagcacgtgccatattggaaatggcagaagcacgggtacgtccccaacaacatagcttggcaatcatcgggtcataatgcagagagacttcaaatccggcataagcggcactgtcaagacgcaggttacgcccttcgggagcttcacgaacagtaatcaccccgggagaaggtatgaagttattctccggatcttccgcataaatacgacattcgatagctgctccgctaaactgaatatcatcctgtttataaggcaacggatttccggcggcaactgttatcatatcccgaaccaggtcaactcccgtacattcctccgtcacaggatgttctacctgcaaacgggtattcatctcgaggaagtagaagttttggtctttatccatcataaactccaatgtcccggcactgtaataacctattttcttacaggcttccacagcaaccttcaacattttctttctcgtctcttctttcacaaaaggagaaggactttcctctatcactttttgattacggcgctgaatagaacattcacgttcgtaaaggtggaccacattgccatatttatctcccatgatctgaacttcgatatgatgcgggttctcgatgtatttctcaatatataccgcatcattgccaaaagaggtccctgcttcggattgtgacaaacgaagagccgtttccacttcttcttccgtacgtaccaaacgcattccttttcctccacctccggcaagtgctttcagcataatgggatagccgacttcattagccaccttcttcacttcatcaatcccctgcacaggtgtttcggttccgggaacaatgggtaatcctgcttcacgcataatcttgcgggcttctgtcttgattcccattttggaaataatgtccgcactcggtccgataaaaatcactccttcttcttcacaacggcgggcaaaatccgcattctccgacaagaaaccatatcccggatgaatagcagcaccggtctttttagcaatggacaagatcaattccggcttcaggtaggaagtatcttcgggcgattcggagatgcaataggcttcttctgcataacgtacatgcaaagctccgcggtctacatgggtataaacagccaccgttgcgatattcatcacccgacaggtacggaagattcgcatcgctatttcaccgcggttggctactaatattttctttatcataatctttttattcttttaatgaacactctccattctcaactctccactctcaacttattaaagcggaagattcgaatgtttcttaggaggattagactgccgtttgttggcaagcatctcgaaacttcgaatcaaccgcaaacgggttaccgccggatcaatcacttcatccacatatcccaattccgccgcccggtaaggattggcaaacttcccgcgataatcatcctgaagttctttccgtttttcttcggggtttccggccttatctatatccttacggaaaagaatattcacagctccatccggtcccatcacagctatttcggcagtaggaaaagcaagattgacatctccgcggatatgcttggagctcatcacatcataagcgccaccgtatgctttgcgggtgataaccgtaactttcggcactgtagcctcacaataagcataaagcaattttgccccgttacgaataattccgccatattcctgatcgattcccggaaggaatcccggcacatctaccagtgtcagtaaagggatattgaaagcatcgcagaagcggacaaaacgggcagctttgacagatgcgttaatatccagcgtgcctgcaagtaccaatggctgattagccaccactcccactgtttttccattcagccggatatagccggtcacaatattcgcagcatactctgcctgaagttcgaagaaactattatcatcagccactgcttcaatcatttcttttatattatacggctgattcggattggttggaatcaaattagccagttccggagtcagacgggtcggcgaatcgtttgtagctacaaacggaggctcttccatattatttcccggcagataggaaatcaattcacgaatataattaatacactcaatatcattctccgcagaaagatgagctacaccggactttgtcatgtgtacgcctactccgccgagttcctctttagtgacttcttcctgtgtcacacttctcaccacatccggtcctgtaataaacatataaccggaatttttcaccatcaggataaaatctgtcaatgcaggagaataaaccgcacctccggcacatgggcccatgatcgcactaatctgcggaatcactccggatgccatagagttgcgcaggaatatctcggcatatccggccaaagaacgtaccccttcctgaattcgtgcaccgccagagtcgttcagtccgatgatgggtgctcccatttgcatagccatgtccatcactttacaaattttcttagcgtgcgtttccgaaagagctccaccaaatacggtgaaatcctgtgcaaagacataaaccaggcgcttgccaatcataccgtatcccgtcactaccccgtctccggcaaatttctgcttttccataccgaaatcggtacaccgatgggttaccaacttatccagttcgataaacgaacctttctccaataataaatcgatgcgttcacgggcggtcagttttcccacagaatgttgtttttcaatgcgagcgtctccgccgcctttttctgctttcctgttcagttcttccaggttgttaataagctctttcataggctgtagttattaaagttgtatgtgtgtgtaaaaataaacagtaatatatgaaatcattgtcatattgattacacaaagtacttttatataatgaacgcctcatgtgtggaaaatgttagcatttatgccttaaaacatctttatccatttatttagggagctttttttgcaggttgcgacaacaaacttccccgcttttctgtttatcgcttatcatttttaataaaacctataccgttgtcaacttcgatgttgaacaaggccgcatcattatcagggaaaatccgaaataccttagtctgaacgaaatgtatcaggtagccaacagctatccgaaaggcagcaaagctaggtaacgaagctgcgctggccaacttaaaacaattacaacaaattcttagcgtgaaaatgaaataaacagaaaaatctttttattcacccgaccaaagtgggacgtttgtttgttatatcaataataaacgacgttccactttttaaatctgataattatgaccttgatccttgctattattccggtgttactgttgattatattaatggcattctttaaaatgccgggtgacaaaagtagtatcatttctctgatcgtgacgatgctgattgctattttcggcttcgctttttcagtagacaatctgttttactcctttttatatggggtgttaaaagccgtctctcctatcttaatcattatcctgatggctattttcagttataacgtattgttgaaaacaaaaaagatggagattatcaaacagcaattcgcttctatttctaccgataaaagtattcaggtgttattactgacttggggattcgggggactactggaagcgatggccggcttcgggacagcagttgccattccggcagccattcttatcagtctgggatttaagcctatcttttcggcaaccgtaagtttgattgccaacagtgtagccacagctttcggagcgatcggaactccggtattggtactagccaaagaaacgaatttggatgtattgcatcttagcacgaatgtcgtattgcagttatccgttttgatgttcctgattccgctagttttgcttttccttactgactccaaacttaaatcgcttcccaaaaatatatttcttgccttattagtaggcggagtttctttagtcagccaatatctggctgccaagtacatgggtgctgaatctccggccattatcggcagtattctttcgattatcgtgattgttctttatggaaaactgactgcctctaaagaagagaaagcacggaaaagccatctgagaacaaaagatatactgaatgcatggagcatctatttgctgattctatttttaatcatcctgaccagtcccctcttcccggaattgcgtcatacattagagaataactggataacccgaatcagtttgcccatcaatgcttccaccgtcaattataccatttcctggctaactcatgccggggtattgcttttcatcggaacttttatcggtggattaattcaaggagctaaagtaaaagacctgttcatcgttctttggaatacagtgaagcaattaaagaaaacattcatcaccgtgatctgccttgtgggattatccacaattatggatagtgccggaatgattgctgtgattgccacggcactggctacggctacgggaagtttgtatccactgtttgctccggtcatcggttgtctgggaacgtttatcaccggaagcgacacctcttccaatatccttttcggaaagttgcaagcaagtgttgcagggcaaattcatgtcagcccggattggctgtccgctgcaaatacagtaggtgctacaggtggtaagattatctctccgcaaagtattgccattgctacttctgcgggaaaccaacagggaaaagaaggtgaaatactgaaagcggctattccttatgcgttggtgtatgtggcgattaccggaattattgtttatattttcagttgattaccccaaagatatctctaataagtttacgatgtctttaccctcacaccctctccctattagctcaaaccgcttattcatcatggttacaggtgggagggtaaacggttactttcaacctgcctcgtaattactcattggaaaatttccggttaacagtagttccactttgtttcattacttgggacaaagtgtttcacaccgggaaacaaagcgtttcaagcattgaaacaaagtgtttcacaccgagaaacgaactgtttcaaggcttgaaacatattttgaaactattcggtcattatttgtataagttctataagttacttataccacatgatataccacttcatgcgcttccgtcagttgaggaacctccagtttatccaacatcttatccaatacagattcaggaagtgcatattccctgcttttattttgttgacgccaagtgtgatatggctgttccagatagactatcttcacttttgcaccataatcaacaaacagatcaatcagttgggcacgcatctgacgagttatgttagtagcattccaaacaaaatcctgtcctttgcgaagatacgttctggcttcttccttcgccatttgcactacccgtccattcgccgacttatccgtgggactcaatttgtacttgcgacgaatggcatccaagctcaccaccggcatatccatgccagcagactgaatataatagtctttccccattcccggaagtcctgacaacatcgtcacttcacatttaaactgttcgtgagggatataatcaatataactgccttctgcatggaagtaatgaaagcgtgcataatctgtggcaaactctctcggtttactccaacaatcttgttcacggcagaaaatctcaaacagttccacagcttccaacaacccattcttatcttcacaaatacgtcctctgacgtcagcttcagccaacattttcagtaatgaagtatctacccgtaaagaagcttcacagagtttctttacagaatccgacttctccatcagccaaacaggcaatccgtgataccggactaaagacgcaatctgctcccgaatatggaacggagcaggacaatcccggtataaaatagtacgggcagtgtactctccttttctggcgtgccctttagcagatacccgcccctctccttcatccacggaagtcgaacgtttttcaacatcatgtaacaatgcagatgtccaaataatttctttctccaaggtgcagagagtctgataagcagaagactgctgcaatgcttccaacaccatacgggtatgctcggccacacttccctccgcatgataacgagtatcctgcgggacgacattcatttctcgtacccactcgaactgctgttcgagtgagcaccacgatttatcttctatcaatttccaattcatcattattctccttttcattactcaattcccagacaagcggggcacgtttccaattacgcgtccaatgctcatctgttttgacgtgtccttttcgcacatacttaaacacatgatgcgcaaattcgcttaccggatattcctcgatattgcggctgactactccttcacgagtacaagccactttcgtccacggatcacatgaaccgaaaacagacgggtcttgtgacatatcgatgatttcctgttttaaaagctccggcgttaaaccggaaacaggttctatcttcaactccggaaccgtaggcaagtcaaataaagctgcataaaacttcacttcttcccatgacaaccattgatccatgcaacgaaccgcaaagatataaaaatgcgtttctaaccgttgatattcaatagaatgtatggcgtatagattttctccaaagatttctatatcgcccaaatcattctttatcaattcccaacgttcccgcagttgcctcgtccagggtgaagtggtgggagccgcatgcgaacgggcaaagacaccccactgactcaaacaattattctctccatccaacttctcggtatgcaccaatgtcttaatccgttggatatcttcccaatacgtatgattaattcggtcatcactagtcgttccgggagagaacggatagtgataggtacgaccatatttctctgatatcatcttcttctttttttttaattaaatacttattcttttttgcacagctaaacagcactaaagccactacccggcaacattccgcaggtcctctgccggaagtaatttgtaaatagactttttctttcatcgcatcattccttattcattcgtacaatgcgaggcataaatttgccttgcacttccactagtgtctcctgcgtatacatcactctgtcaatgtccttgtatgccagcggcatttcttccacgctcccaccaatcaaagttactcctgcttgcgacagtaacttcttcaaagccgattgcgtaaaactatcttttgccttttggcgggacattgccctgccggctccatgagaagccgaattcaacgcatcttccacccctttgccacacaccagataacccggggtggccatacttccgggaatcaatcccgcttgtcccttttgcgccggagtagcccctttacgatggacgatcgccatacgtcccggtgttatttcctctttccaagcgaagttatgatgattattgacattagcgagaggcttcaaccccaaggctttcgccaaattcaaatgaatccgttcatgacaggcacgggcataatcacctgccagattcatactcatccaatactcctgtccctcttccgtgttcaaatccaaccaagcaaaatgttgtgcttcacgaggaagcctgcacacttcacgtgccagcagactgtaatgttttgcaatagcagcccccaatcctcgtgaaccggaatgtgacagcaatgccaggtaacttccttccggaagattcagtacgtttttttcttgcaaagtgatctcgccgaactctacaaaatgattgccaccaccggaactccccagttgacggacggcctttccatgcaaatccctcaataaaggcgtcagacggaattcctccctatccaacacttcatgttcctgctcaaaacccaatccgccatccataccgaaatgggtgaaatctttcaaggcttctttcatctgataggcataccgtttcagaaaatctgctccggcatcgaatactgtcagactcatccggcagccgatatcaactcctacggcatacggaatcaccgcattatccgtagcaagcactccaccgataggtaatccgtatccggcatgagcgtcaggcatcaatgctccgcccactgttacgggcaagcgcatagccaggttcatctgttgtttggcaagcgtctcgataaatttacctccataggttttatacatcaacggcccatccagtaaatcataagctataaactctttcgctactatagtcggcgaaaggcgttcggccagcttattccatatttcattgtttttgtaagattcgggatgctcgagtatatcgctcaatgtcatttcaatctgttccttcgtgttatatttgcaatgtttgctcacaatgtccactaccagactgcgggcaacattatcccggtatcccagtttacttaaatcttttaatcgtattcccatactcttttttcattcgcatacaacattccctgtcagcctcaccggcaaacgacgatgcaatacacgtgataccaatgcttaggatacggatataaaataccctcccaccgcattgaagtgattaattttaaaaataataaatgtgattgcaggactaatcaaccattgccgcctgttagtagaattgcggtcaatgtaagaaccatcagttcaatataaaaaataataagttgcaaagcctcatcctcccgacgagacaacttagtcctaatttgaaaatattataactccaacataattaataccctttccatcaattttaaagggtgaatactcattttatcgcagcaaaagtagtgcttatttttatatcttccaaagattaatagacaaattttagtgttcaataactatccgagggaagttttgccaagagtttctgtcaaattgctattttatggtccctttatatcgcctatctttgcatcagataaaaacaaaaagaaagataatatatgaaacggataaaaagcttattaagtgtcttcgtcttgacactggcagccacggcttgcgcgggaaacagcggagaaaataaaaaaagcaatgaaccaacaaaggaggacaataaaatggaagtagtagcattaaataaagcagattttttaaagaaggtatataactatgaagccaatccgaacgattggaaatttgaaggcagccgtcctgccatcgtagatttctatgctacctggtgcggtccctgcaaagtgatgcacccgattctggaagaacttagcaaagaatatagcggcaaagtagatatctaccagattgatgtggacaaagaacaagatctggcagcagcattcggtatccgcagcatccctaccctattgatgattccgatgaaagaggaaccgagaatcatgcagggagctatgcctaaagaccagcttaaaaaagcaattgatgaatttcttctgaaacaaaataacgaagcaaagcaatagacttcgacttttttctcgtcatggcaactgccctctattcgtctttagaagatggatagagggctgtttatatatgccaaatgataagaataaacatatttgcatatattcgcacttcactttatcttcttatttatatttcaaattgaaaaaatgcagaaacattgaataatactacatcacgatctcacactctttgtttcatcacaaacccctcaaagaaatcgtcgcggtaactattaccgatagctatttcatacgattttatgaatatatcattattgtcaaatgattcgatgtgaccggtattgacaatatatgacttattcacccgcagaaaagttgatttgggtaacaaatcgaatatggctttcaaactcatacgggtgataatacgttgatcgctaagttggattataacgtaatctttcaatccttcaatgaagagaatatcggagaagttgactttgaaataccggcgttctgctttcacaaaaaaatagtcggcagtaaccaccgtttcgatggcttctttctcttctttcagtaacaaagaatggtaagacaaagccttatccacagctttttgaaaacgctccgcttcaacaggcttaatcaaataatctatcgcatccacttcgtaactgtccagtgcatactctgtgtaggctgtggtaaaaatgaccagtgttttctttgaaatcgtacgtgcaaactcaattcctgtaatccctggcatctgaatgtcaagaaaaaccaaatcagccacatgttgctccatgaaatcggaagcagtggacgcactattaaaactcccgattaattgaaggttattcgattcttctatcaatagcttcatggcttcacgtgccaatggttcatcgtctacaataatacaattcataatgttatacttaaaattacagtatatttattttcattctctatctgcttcagttcataccgaccgggatacaacagccccaatctgcgttgaatattcacaagtcctatccctccgactttccctttactaacggcaacttccggtgtggaattctcgcatcgaaactctaatctatcattatcaactttaaaagaaacgtgcacatacgaaggatgctcgctgtcaaaactatgctttaccgcattctccacaaaaggaataaacaataacggctgaatccaaatggaatctgtctctccatgttcctccatcgtaaactgaaaattatcacgacggatcttttccagattcagataatcatttaagaaatgaatatccgatgctaacgaaactctttctcgcgagctgtcatttatctgatagcgcagtaaatcttctaatttgaaaagtactttggatgcttcttccggatttctctttatcaggacattggcattattcagcatattaaaaagaaaatgcggattaatctgatttttaagaaacttcagttccgattgtaaagtcgtggattccagttcatcaatacgcaggttatagcgtagccaatgcatgaacaatgagatagctgcagagcctgccatgacaaagccaatggtcagtatgcccgaaaaagcattgataaaagtggcaaaaccattgggatcttttccgggcagaatcacttcaaaaagcaaaccttgggtaactgaaagaaaagtaatgactgctatatttgtaatgactgccatcaacacataactaccccaacgattcttcaacaggaaataaggaaccaatacatacaggtttatatatatcaccatattcatagaagcaaaatatgccagacatccgcccagtcgcctcccaaaagagactgtttgtaaaggctcataccaaaggacattgattgttatcaaaacaacaaccaattgcagcagcaaatgcctgtatatccgataacggggactcaatagaaatgcagtgacacttttatcattcatatttctgtcagtggtatttttattgaagtcattaccatgattggtatccctactcatgactcacctcctttcagttccagccatatactgccgacagccaatgacaatctgtaacggcttccatacaaaatatccaatctttgtctgattctttccagccctttatcggacgacaagagatttacttcaggacaagcgcaagcgaaaataatcgtacccttttccgctttcaaatgagttttcaatgaaacaggaggctgtatctgttgctcgtctattgctttgactatatattgtacaaaagggatgaaaagcaaaggtggtaccaacattctattcacttcgccttcggaagtaaattcatagtaaaattgtggtcgggaggtctgttccaatgtcaggtaattagtaagaaatgtaatttcgctactaagcaagactttggccctattgcagtcatacaactgatagcggagaagttggcttaacttcatcaacatctttgaggctgtttccgactcactcaacgttaattctcccgattggtgcaatgttttaaaaagaagttcagggctaatctgttcttttaaccgttccacttcagaaacgacatgggctttctccatttgtgaaacacgccggttattaatcatccactccttcaggagaactgtcatcgtacctcctatcatacacagcgtagataacataaaagaagaaatatagtccactaccatgtgcatcgaaaaataagaacctcgcgcatggagttccggccaataggaatatgccatgtattctattgacatctgtatcaacagagctacgatcatcgcagcagaaagtaatgacaaataggtcagataatgtctcttcaacaaatatttcggaaagagttggaaaagattcaagtagataaccgctacataagtgagcaggtaaagaaaggtaaatgtgtaaatccatccgcccaatatatccttataatccaaaaagataataaagacctgattgaaagagatcgtccccagcaccaggataagtaccaaataccgcatccatcgtaagtccggactaacgagaaatcgatataaaaaggtagattcactacctgttgcaagtgtttcagttgtcatacgctttattggggacgaagataaaacatttttccggttagactctataccgtatctctaaaattcaagcttataactcacattcgtcaatatcgtagaattgtcgctgacatctattcttccagttttcacattatattcatgcccgtaatgttctttagcacccgtaaagttaagtcctttcactgcaaattcatgtgatacttttctcttgttgatacgataactgacagtataattaccaatcaacataggagaatattgttttgagaaagctttcgtttcgtcatattgcacttctttatccggatgattcatcgttgcctccaagtcaatcggagaatatcgatcaccaccttgcaaggttagtttcaggttgacactaagtatattctgtttatttcttcccagcatccattctttaccgatgagtccgtttatcacataattacggttaaacttcgtgttataccacacaccgtccccaccccggtaacgggaatcaaaccaagaacccgaaatcatataataaagtcctttctccaaaaaacgttcgaaggtaatgtctattcccacattgcgtcctcttcctttattaaccaacgcatcttccacataaaaatcagaacggttaagtacggagtaagaactatccgccattactgggacatcatgcaaaaactggatatatggttctatcttcagattcatgcgatcagaaatcttgtaaccgaatgataacataatgtgctgtgcttttgtaaaatcaagatctttattgacggattgattgcctgtacttttcgttttaacaaaatatacatccatcttttccatacgactgtacattccataagccaacgcaaaggttgtttttggagtagcttgccacttcaagccaacccgtggttctacagaccatttattgttcagagtcagaagctgtccatagattcctgcattaagggtccaacgctctgttaatcccaccgatgaactattgtaggctgaaatcagacttgtattaccttttccttgagatacaatttccagtggttcggcttcataaggagcaatggaaagatccattttgtagaacatattggtataggtgaatcctgtcttgttcgtaaaacggttactgaatttacgattaaaggtagtggtaaatatcaggttggtatattttgaatcaagatccatataaggagtagactccatcgaatggttgaacaaggttgctcctccgtcgagttgcgaataggtagcggctatcgtggtcttcaacgatgcgtcattattaaagaaataacgatggctgacacctccggctgccatatattgcttgtctcttgattcactgcggtcgccccaataatcccatttctctgtgttcttctcaaaatcactggtgaacttatcaatcaggctcgttccccaaacagagaacgttccggctttctgtgttggaaagttgagtttgaggttcaggtcctgataatccatcgttcctccttcaagattcagaagtccggttgtagaataacggtaattgaaaatatacgatgctttatgtttcttgctcaaagggccttcggaagcgacgtcgattcccataattcccacctgaatggtattttcgttcttttggttgttgccgttacgcaatttcatgtcaaagactccggatacagcatttccatattcggcaggaaatgctccggtgaaaaaatcagagtttccaagcacttgtgaacttagagaggaaaggattcctccacccaacgtagcgatgtccgcaaaatgattcggattaggaatttcgacatcctccagtctccattgcaacagatgtggggcattgccatgaatagaaattccattggaagaaacgctgggagctactccggcaaaagcagaaaccaaacgtgcgggatcatcaaatccacctgcataacggctcgcttcttctacactcaacatacgtgctccggtagtagccatcttattcattgcttcttccttgttcgtccgcgcacgaattattacttcgtttaattcgttcacgctttctttcaaaggtatttccaaatatatttccttggcggaggtcaccagtatttctctgaaaatgcccggttcatatcccataaacgcagcttctacggtatgtcgcccgacaggaacctgcggtatactgaaacgaccaagactgtctgttatcgtacccgccccctctttttcagatagctttactgttgcatacggtatcggaaacttcgagtctccatctataacaatcccacggatggtctgcaccggacgtcctttccgtcctgttgtctggctgaatactgttacagacacaaataaagcggtcaataataggatccatccgccataacgatatattttccgggaaagttcttcacttagaactttttcaaaagttttgagcactgtcccacactcatctaaagagacacccgactgaatagatattttctctaataatctagttttattcatcttcatgattttattccgtttttatttcgtcacgaagataaggcagagatcagcactaatttttcaaatgagacgaacgtgtcccatttgtagactaaatgcaaaattagcaagatgaaaaataaaagaaaagaagaatatcgcttttaaaggatatataacccattctaaaggtggtgtgactttcattaaagtcctttggtaattacaggcaacccaaataagcccttttgcaaagtcagaatcttcggccgacctgtctttgttttattataagtagaaggagatacatgcaatgtttctacattcccattttcaaaagctacctgcaaataatattctttacgaacgccatccgacacataacgatgtctgccgactctacgggttttcttatgtgtttctatatattttttctgtaccatgactttctcttcatgcgtggaagcagaatcggcgaaccaataattccccccaagaaacaatacacaactgatagcaccgacacaaaccaaatggcaacaacaattaataactttatcatccattgttgtcagccaaatccatcctttatagaaaggaattgttgctatcactattataagtgccactctaacaggtatccaccaggcagccaatgtatcttcgtatactacataggcaactccacatgaaataataatcacgagaatcatcaggacacgaagtgtattaataaatataattttcatgatattgtagtatatgtctgcaaatatacagaattggccaaataaataagacaactccaccattaaataataaatgaatgaatgagatattatcaaaaaaactacaatctaaataattatcagactgtagttttattaacttatgcttaaaggcaaattctatcatcgacatccacaaagcagccctaaaagtattcctattcttttataaaagaaagagtttgattaatatgcctggaagatgttcctagaaaaattgtatattgtccagtatttgtcttccaactatgtgtctgatcatcccaaaaagctaaatccttggaagttattataaattccaaaattcgattttccccaggtttcaaggatactttctcaaatcgttttagttctttttctggacgtaatacacttggctggttctctttgatatataattgtaccacctcagctccttcacacttacctgtattcgtaagagtaacagaacattttatagtctgtttatcattcatcttgttagatgataatcgcggttttgtcaaagcaaatgttgtataggatagtccatatccaaaaggataaagcggttctatcttctttgtatcataccacctatatccaactaatacatcttccttataattgacatcatacacattaataagatgctcatttttaagttcattatagagtgatgccccttgtggcaaatatccccatgccggtgaatctttaaatgacctttctatagtcatcggtaattttcctgatggatttacttttccgataataatatcagtaagtgcttcaaatccagattgtcctccataccaaccataaatcaaagctgctaattgttcgttccatgctgacatatcaatcgcagacccagtattgataatagcaatagtgttaggattatttttagtgatatagcgcataaatgattcgtcttccctaggtaaagcaaacggacgttctacggcttctttatcccgtgtacccatgctcaataaaacaacatcagcctcttttatctctgccacagtaggcttttcaatataatatacagttcgcccaaagactttctgcaaagcatcaatcagacttacattattataccctatcacttctgccgcaccatagccacgaggtatttcatatacaaatttaccggttaataatatttttctatttttcgtaggatcaagcggtaaaatttcattcctgtttttaagtaatatcacaccttcttctgcaactcgcctcgcagtttgctcatgttcaggatatttacttaacaaagtcgtgtcatacttaggcctgctataaaatcccatggcaacacaagtagccaaagtgggccgtatcatatcgtctaaatccttctctgttattttcttttcatgatataaatccaatactgatactccaaaattatatgaacccggcatttccagattttgacctgatttaataaccttttccaaatcccacacagaattccagtcactcataaccaaccatttaaatcccagcttttctctaagaatcttctttattacatacgaactttgtcctgcccattcgccatcgatctgattataagaagtcattacagacatagctcctgcatctatcccagctttaaaacccggcaaatagatttcattcatagcacgttctccgataatggaattactccgtttacgataaaattcagtattattcccgtagaaatgctttaaacatgccgctgtacccgtactttgaagtccggtcacatattgactgaccatttgagataccaaatagggatcttctccaaaatattcaaaatttctggcacattgagactgtcgatagatatttaatccgggacctaacaaaacctcaattcctccagctctacattcttctccaatagctttagcatattggtaagataactccggtgaaaatgttgaggctagcaaaatgggagaaggaaaagctgttgaacgttccagttgctttacaacgttaggatcaggcaaattattccggatattaaccccttgtgtcgcatccgacaaataaacaggaagtattcctttttcttcaaaacctttgataaaaaacttattatagcccctgaccatgagcgctttttcctcaattgtcagcttctttaataattcatccgccttcttgtatgcttcacttgtctccattacctgttgtgcatataaaccaatgcaatttacaagcatgaaaatcaatagaaaaagttttttcatattctgatattaattgaatgtggaacttctcttttactgattaaaagagaagttccacaattagtttttagttattgtataaatcttgtatttcttcttctgacaatattctgttatacaaaataaaatcatccagataaccattcaagaagttctcaggtgcaaattctccattagtaaatcgatagttacaaccaatatagtatggccaattatctaccaccttgtcaacaacccctttcttttcaataactttctgcccatctatatacaaataactatctctttttccatccactttcttataaatacatacatagtgatgccactcaccgtcatccattcgtttaccttcatattcagcccagtttcctgcttttcccttgtattctacacagaaaacaacagttttaccactggtatcaagtctaaaccaactttgtctgggcacaggatcggtataagtagcaccaggtcccacaccttgatgaaagactgcattcttagctgtcatatttgaaaccttcacccaaaatgcaactgtaaattcactatccgtataatgattcttcaatccttcttcaggaatagacaaaattgaataattttgcttgtcgccttggaagtgtgctgcaaatcgacattcagcactttctccggaaaagcgcgcctgagaattatatacactggaaccagctcctgccgtaagttcctcaggattcaattgatttggacctgcatctttattatcaccatcgaatggcaaatacaatactaacttttctgcagaaacaacatatacataaccttctttctctttcgtagagctatttactgagtttttagctttcaacgtcactttgtattttcctggattattatattgcactacaggattttgttctacagaactggctggagtacctccttcaaatgtccattcccattcttcaaccgttcctaatgtcttatccaagaagttaatatatcccccggcataagtattccggcattgtgcaccaaaatcagcggcaatcgcatttttatcaataacagtaatataatcctctcttactttgtccgaagacgctttgggattcttagctgtcaatttaatagtatagattcccggagaaagtgtcatttgtggattttgttctgttgaagtgataactgctccaccttctttaggtgtgaaactccataaccactcattcggatagcctttggacaaatctttaaaagaaataacatcttcatttgtagcagtagttttatctgcagagaagtcaacagttatctgcgacggatagttaacagtaatatattgttccttcaccatttcgtttgcttcttctccgcgtccgacagacaaggtaaccgaataaactccaggcttattatatacaacattgggactaaataagattgaggtttctggttctccaccttcgaaccgccaattccatttagaaggttcaccagtagatatgtctttgaaagtaatactttctccgattgtgacttcctgaagatctgattcaaaagcagcttgcaaggactgcaaatcatcttcagaacaagccaataacaatatcacaacaatacactgtaataaatatatagtttttcttttcatatcagtaatgtattaaattcattgtattgattttatgctaacaactttaaatgccagtccatccgtatatcgtttttctcctccctcatagataatagcaatctgtgaatcagagagctcaactatatcagagtaaccagagttaccttcataaactgtatattgtcccttccagttcttcccattatccgtactttttttgatagtcatattaatacgttccgtagcggaagcagcattcgaaagaaaaacagctcctcctattgataatatactaccctgacacttacagtctatttgatcaatgctaatttgaggtgaagaccaagtaagtcctccatctatgctagtacaacttttccgataaaagccttcatctgctctcatattcaacattaacgttccctctcctatctcggctacagaacattctccaacaccaccgacaggagtaggttctcctggtttccatgtttttccgtaatcatcagaataaatgatatgagaataactcgtgacctttccactctcccgagttgtaaaatagtttggagcaactaatcttcctttatgtattcccttttgaatctgaataccatggcacggaccggtagcataccaatcccatttttctttttttacagaagaagttatttcaactggttgcgcccaagtaatgccgtcatcatcagaatatgtatagtacggacgtcggctgtcttctccggtaccattggttattgccccccatttatcagtctggaaattccaagtcataagcagatgtattctacctctgtcgtcaacaataggtacgggatttccacaagtgttttgtccatcattccatatcgtaatctgtttactccatgtttttccattatccgacgaacgtttgactacaagatctatatctccgctatctccattacttcgagcttttctagcttcagcaaaagctaataaagtattgcttttacttttaacaatagcaggtattcgatagacttcaaaaccatccgtcccttgattataaatatagttgaattcggacgaaggcacttcttcttccggtggaacaggagttggatttccttgtgtctcatcatctttttgacaagcctgtgtaaacatacttgtaaaaagaaatacgcatgtaataatcttataggttttcatatccttgagtttgttttaaattaggattgatatttatatcgctcaatgggattgcaagatataatggaatgataatattatcatcgacttttttctttaagttcgggacctcctgataaacatcaatcgttccaccataatgaaatctaagaagatcgggccatctttttctctcaagatataactctcttgcacgctcgttcagaatttctttctccactgctattttattggtacttccactataagttccaatcttggcacggtctctgactctattcagttcaataatagcctgtggcgtttgatttaacgccgcataggcttctgctttaaataaatacatctctgcaagccgatatataactatatctgagtcataggtgcgatctccttctgtttttgttcccttcatcttattatcaaaagtccctatttcatttccgtccgcatcctttgcagtgatataagagtctttggttctgatatctgccggattagcattaaaaagacctatcaaaaacggacttggtgcataagtgctgcgagctcctcctttagcataaggaatttcatccttattgaccgccttttctacaaaaacatctcttggcttcagactctgactatactgagcttccttttcataaatttcgaaatggatagtccatatcacttctttcccatatttagttccataaatatctgcaaagttatcttccagtgaaagtcctttacttgccaaatccgcataagttatgacatctttcaaatcttgttccgatccattcatcacttttgctttccatagcaaaatatcggctttcaatgcatagcatgccggcttcgatgcccttccttttccatttgcataactttcttccggaaaaagatcaattgccgtatttacatcacttagagcacgtgccaaaacttcctccgcgggttctcttgctaacttaggcttatttgaactttctgtcggttccagttccaaaggggcatccccccatatccgggcaatacagaaatacatataccctctgatacaatacgcctctgccaataatctgtttttatcagcctctacaccaaaatctattccgggagtatacttcagtaacatattacaatgttgtattacagagtaatagctcgaccagctataaccattttgcgatgtgaggttttgcgcccataaattagaagggccaccttccagccctgttgtaaaggcatctcctctgtcttcaaaatgaagagtagaattcgatgtatcgcgcaatttggtataaataccgatcatataactttctacatcgccttttgtattccagtatccatctccggtaatgcttgaaacagtatctacatccagtaagttacacgaatgtaacaagaataaagaaatgcctaatagtattgatttaaattgtttcataattatgagtcttatttaattagaaattaatttttactcccatgttatattgtctgggtctcggataaataccatagtcaacaccagtatatatttcagggaacatgccatcatatttttttatataaccaatattatacgctcctgcaaaaacttccacagcactgagtttcatctttctaatccaagataatggcaacatataacttaaagacacttccctgaatgccaggtaatctcccttgctaaaatacaagctattattagtactaccacttgcagagctcccgatctgattatcccatctcatatgatttctatattgataatcatagtcgctctgaacagtatatttaggatatttgctcccatcattcgcactctgccaagaattggtcattgcctctttgatggcattattattattacgtgagctacccattatctgtcctttgaagccattgtctattacatgccccatagcccagtccataacgattcgtacagttagtcctttgtatttcaatgtattaataattcctccgactttatcgggacgaacatatcccatgaaaatcatgtctttagagtccaattgtccatcattatttacatcttcaaatattgcatctcccgcatgtttctttcttccttgtgcgttcgggtcattaggtgccttggccgcttcttcttcagtctgatatgttcccaagtaatgaaaagcccatcttccgccaaatctctcaccttcggcaataccacccactttttttgtccctccagttgcaggatcataaacaaagtttcctcctacacgatgcttttcttctccattatccggtaagtctactaccactcctttgttataagcaaatgtcaaccctaaatcccatgagaaatctttagtttgaataggagtagcattcaactcaatctctactccggaatttcttacagatccatagttactcttaatggaactaaatccggtagaactccataaaggttcatcatacaatctgtcaaatgtcagtttgttgtaatagtcgattaacagtcctaatctattattgaaaaagcccaaatcaaccccgatgtcataggattctgttgtttcccaacgcaactgcgaatttttcaatgttgtatttaatataccgacagagccctgatagttggtatctgtaatcttatattctcctctcgaattagccacactcaaattgttgttacctgtgcgcccccaactagcacgccatttccaacgactaacgatagcttccaatggtttatagaagttttcccgatgcatattccacccagcagatactcccgggaaaaatccccatttattatcttccgcaaatcgcgaagaaccatcggcacgcatactgatagagaaaagatatttgccattataatcataatttacacgtccgaaataactcaaagtggcttccattgttttagtcgaacttgcccgctgagtactatctgccgttgcatttaatgtcggaattaaatctatggaagaaccactgccacttgcagaaagcctataactataatcatgagtatagctggcacctgctacgactccaatattatgatctttcactttcttatcatacgagagcactaaatctccctgcaaatgcctgtcaaaattatgtttggcagaagccggacgaattgtatttccggttgtttcattatctgcctgaaaataattttctataccttccgtaccgaaataataggctgtaggctttaatatcaagccaggcagaatattccaaattgcacctaattggaaagttgtcctatatacattggtatcatcatagttagtcttataataaatttcatgcaatctgcttctgaaagaagaaattccttcacccggagccggagttccatcttcataatacaagcggtaagttggtggagtcaatatgcttcgtgatatggtattaactgtatttccacctcctacagcatctctcacctgcaaactagctttagtagacagactccatgcttcactcaatttatagtttccattaaacaaaacgctgtaattcttataattcgtacctcgaagaataccatcctgattcaaatatcttaatcctacataatagttaatagcttccgtccctccactaatgctcaaatctatttcatgcttctgcccagttgtaaaggtggctttctgaaagtcattatcctgaaaaataagttgtttacctgtaacaggatctgccattgtctgccatccttcgttttccaacaagttactgacgtaaccttgaccatacttttgaagataaacatccaaaaactcaagcgtattctttgaatttctaggatttccggttgacataccaaatgaaccgctcaaaaatttagcctgatcttcttttccattataagtcaagtctgcctgattaaatttggctatattcgaacgagataatgttatataatcccgtgcattcaataatgggattcgctgaggttgttgttccactccgtatgtgtatcgcagacttacaacaggcttccctttctgaccggatttagtcttgacaagaataataccattggccgctctggaaccatagatagcagtagaagcagcatctttcaagacctctatagattctatatctgccggattcatatctgatatatttctaaaaccttgtgatattataccatcaataattattaaaggcgtatcactttccggcgaagttgaacttcctccacgaataaataattgaggatcagctccaggctgcccactagaaatctgtaaagacagaccaggcacttttccttgtaactgtaataatggattctgtccgggtgccttctggaattcttccttatttatcttagaaatagaattggttattaatacccttgattgttttccatagcctatagctacaacttcatcaagcaatacagaactctctttcaaaacaatgacaatatttctacgccctttgactgcaatttcttttgtttccattcctacaaaagaaacaataagagtagcgtcaggagaaaccattattgagaattcaccggacgcattggtaatggtacctttatctactccttttacagaaattgaaactccgggcaattctaccccagtttgatcctgtactataccagaaactttaatttctttagaactgatatcatctgcttgaatatttagggaaataaataaaaaagcaaataacaccgataatattttattcgtatgctttattgagtttttcataaaatataaaattaaaatttgaaaattaatctttcatatcaattgttttaggtcgcagacaagtgaccagaataaccagcatagccagtaccaatatagcaagcagtgcaaaatcacgtcccaggtgtccggcatccattgattcgcctaaaaggctagtaatagcagctccggcaaatacaccacacatattcataataccataagcggttgccctgtaacgtgcagatacaaactgacaaagaataggcatattatttgcatcaaacataccaaaacctattccgaataacaccgctcccatgaccaatgcaaaaatagaatgaccatatccgataaacagcagggaaggtatgataagccccaaacccaacgcaccagtataaactcttccacgtacattttttaatacccattgatccgagatgtatccacctgccaatactccgaagagtgaagataaggctatagaaatggtagacataggacctgctactgaaatatcaatagacaagctatcagaaaaaagagttggtaaccaattctttgccgcccatcccggagtacccggcacacagaaataaaataagataacccagaagaagacattagagaataacattcccaagctcttcaataccggaatctttttcatcttctgattctccgagacatttcctctctctttatcacgtaggaaaaatgccagaataataccataacctatacctataatgccaaaccaatgaaacgtggtatgccaggaatagattgctgcaaaagtagctccgaacccaccgatagcctgtcctacatataatcccgtcatatgtattcccacagccagcgaacgagttttatctttgtgaaaatcagcaatcagagacaaagcagcaggtaaatacagtgcttcactaactcccataatcccacgcaaccaatagagttgattgaaagtggtggcatagcccatcagataagtaactcccgaccatacacacagactacctacaatcaaccatttacggttcacacggtcaccgataatacccgacaaaggactcatcagtccgtatacccacagaaagacagccatcagacgaccaaaattggcagccgattccaattcccggacatcctccatcatcggaattcgcatagtggaaagcatttgcctgtccatataattcagcaaagcaacaccccacaatagtccgactactacccagggatatatatttgaagttttattattcatgcctgtttactttaaaatctccgttaaatcgatttttataaaagctaaatccgactgactgctctcatataatatgcctattgaattttcatctatggacgtaatgcaggaatatccggcactgcgatattggtcgaaaagaatccaatgttcctccggccaggtcattccatcatcaaaactcactttcaaagtcagtttatcccttttcccataatcattcggatttacaaagagaagcatgcttttcttttttccttcttctatatattcatgtcggtgcaggcttgccatacaggtaggttccaccagtgcctttcttgaagtaggatgttccttccaactcgctcccaaatcggtagtcgtacaaattctccgaccgttcacctctttatgtcctctgttccggttgtcacgcatgttcaacatcaggacgccatcattcaattgtacgacactacattccgttacatcctgatatgcagagttgctggtcacccacgtctttccgtgatctttactatacgtaatatttgagaaaggaagtcctttttcatcacgtccctgtgtgggaaataccaacgtgccatccttcaacgtaatcccttgtcccggtgccggtgcaaacagccaccattcagggtgtttcgtctttgcggttatattatccggaaaactccagctaagaccgtcatccgtacttttcgctatcataaactggcaggtttcttttagtcctgttccgggttgggagccttttcctttccattggtgtgtccagaccgtgctactttcattcaatccttctatccacttgccatctttatccagcaggccatgcatccacaatccggctacataaatgtcacctgtatttttatcgactagaatacaagcatcgctcactccattgtatttctgcggcaagccgccccattctcccatatctaatacagtctgaacaggttgccaggtcaatccctgatccgtactccgatgaagagcaatgtctatatttccttgcaaatcacgagagtaatcataacgggcatcaaaaatggctaacaaagttccttgattgctggtagccaatccaggaatacgtgacgaaacacacccatcctgtcctttctgccgtaccgctactcctacccgcaaaggtttacttcctttttccgagattttcagattgcctttagtcgttttaatccggttacagttaagttgaatacggtgatccaatgaaaccgtatctttcaacgtcacggctacccaaaaagacaaagaatcctgatttacctgcactttatcagtaaatgatattttacgtgcagcgggaagtgatttatatagcaaacgggatgtatctatcagtccattttcttgtgtaccatatatagcaacagaaacaacatctgccacatctgtactccctaataaatctaaatctatttgctgaatggcgtaaggttgattgtctgccctgattagagtaacctttaatacaggacttgccgatttcttcaccaacacaggaattaccggtcgttccagcacccattttatttctttacccaaagacgtggctggcaataccaataataaaatcattgaaaatatgattaatatttcccttcttactttcatagtatttttattttaggtaattttgaacgcatttaactagatttgaggggaatgacagaaagtaaaatagctaaaccccagcaatatacttttactgtcatctcctctttttatatctaaaaatcgaagaaatttattgcatccaaatcaccttttaatttgtcatactcctcaactgaaaaaggttttatcggtaaacgacaactgccacaatcaatacctattaatttcatgatagctttacctccacgtacgcctccaccatatttaatgataacttccactgtacgtatagatttcatttgccagacacgtgctgtttccacatcattttgcttcattgattcaaaaatggcatggtaaacattgggaatataattatatgtacttcctacgcctgccacagctcccattgataaacctgcaatcagaatctcgtcaaagccatgcagaacttcaaacttatgctgctccaaatcgatgcaagcccccatctccatcaggttattatgagtaaatttagtacctaccaagtttggtattttcttcttaccctctaccaaaaatctatctaccggcaaattaacccctgtgatcgacggcatattatagtaatagaaaggcagtccactggcagacctgcaaaccggagcaaaaaaatcgatcaactcatctaccgttcccggcttgaaaaaagacggagctattgaagcaatggcatcggctcctgctttttccgcatgacatgccagttccatagcactccgctgacagtttgaacctacatgggcaatcactttgaaccgcttaccagccgaagcaacccatttttcaagaattaatttacgttcatcaatcgtcagcgaagagaattcaccggtcgtaccacacacaaacacccctttaataggagttgatgcgatccaatcagcatatttttcaataacagataaatttacatccccattttcatccattggggtgaaggtggccgcaaccatcccttccagtctttcataattgttcataatgcatttaattagatttgatatttcattttatttctagaaacttccctttagaataaatggcgtccgtattcccggctgtacctcaccacttacgataaatacctgatttccgacagaaacaacatttgtagtaaccggaatgcgataaggacattcgagcgaatctaccagagaattcgtacttgtactaactactcgtaacttacggctgaatcccggatgctcggaagatgtaggaagaatctcttccactcccccaaatagcagaatcttatcctccccgtatggtataccagtccccgccattacaggaaaagaaccgatcattttactccattttccaatgcctggctcaaatacgtacccctccgtatgttctaccatcgcctcatccggagcataacttcttccgctgaaaagataaaatcgttccccttgagccacacctactgcataggaaagagaaggaccattccaatccggcatttcttgccatcctctttctttatgcatcaaatcaagcatgtaaaaatgatgagtcgactgttcatttaccatagtctcttgccccccagcaatataaatacagttatcatccattgctcccgttgcattcgccaacggaaccggcaaagatggataactgacagagtctatcacaaatgaatcttcttctttctttatcaggaaaacgttatcactacactgcgtacgatcacaccctccaatacacaacaatccttccggcagacttattgaaactccataagcaagcgggcgatcgagaaaatcatcataaacagtccattttcccgtttgtaaatcatagctatataaagtagaccaccaagttttcgttcctccttcccaaggatacttgtcaggaaagttagctccgcccagcacaagcaactttccttccactatcccggaatatgcacctgctaatccgacgttctccggcatgccggcgcatcctggaagcagcaatgagttttcccattgcacctctatcctcttttccttttttctcaaacaagatgtattcataaacaatattattaaggataaacataaaatgatgaaatatagtcttttcatatcccttctaccttttcactactttctttttctgccatcaactcctgactccgattgaccttgaaaatcttataaacctcaaaatgtctttcgatggcatcccggtatcctttttcatcccctttttttataaaatccagcaaatcagcatgagtagctattttaccacttttactcatttctatatttataggtttcaaataatctttgaatttttctttcacatagacaagtatagggtgaatgatttcctgaaattcggatattattttatttccagtgattttatatagtttcgtatgaaaagccgattcactgattaatgcgtattcattattctcaaaaacaattcccattttcactatctcgcttaattcttcgatgtctttaggagttatcttacggaaaatatcgcttgatattcctatttcaagtgcaattctgaaatctaacagatctaaaatagtttcttcactcaaaacacgaggatctatcactcttttcatccctcctaaaatagaaggttcggtcagaaccattcctttgcgaggacgtgcatgaatcagccccatcattttcaaacgactcaatgcttctctgacaacactccttgcaactcctaattctgcagccagattattctcattgggaattgaatctccacgccttaagtcattctttttaaagtaagtaagcagactgtcttccacctgatcgattaatgttgtttgattaatttctatcttcatattattagaattttatgatttgtattatttgtctgacaaataatacaaatgcaatattaagggattttttttagaatacaataatattagtatagaaaacacactcacttatgctgaaaaacataattttcggcacaggacaagaaacgttcacttgttcaacacattagaagattattcccaaacattgcatcaattacttgtccgcctcacataaaacaaatacctttactgcataattttcattatccccttacaacaaaacaattattttcttataggaaaacaaatagttttttataacaggacaatagacaccctataacaggacgagcaaaattatactaagcagtttcataaaagctacagtaaaaaacaataaagaatacagagaatatatttaattatcagaataatggcatattacgactttaagaagaaaccggctctcactacaaaagagggagaaaaggatgtgttgtaccccagcattgtatttaacggcactatcaacaccaaacaactattgaaacaactcgttgcccgcaccggatacaagccgggagtggtagaaggtacactgatggaacttgtagacctcgtgggagaatacataggacaaggctaccgggtagaagtaggtgagttcggttatttttccggaaagataaaatcccgactggtgaaagataaaaaagacctgcgttcaccttccattcaattcaacggagtgaatttccttgcttccaaaacattcaagaagaaagcaacgggtaaactggaacgggctcaaaaactatttttccaagcttcaagccaactggatgacgaagaactgaaaagaagactacttgaacacgtcaaccgatatggattcatcacacgcaccacatataccgaactgaccggacgactgaaaaataaagcattagaggatttaaagcggtttgccaaagaaggcataatctgtaaagtgggacgtgggaatcaaatgctttttgtgaaaaaccaagaggatagtcaaacagagcagaatatataacataaaaaaaggctatctatcccagacagccaatctttgttaaccttaaatctaatactatgaaaaacacactacaaagatacgagcttttcggttatctccaaattttcaggtcaaagcagtgtatcttataacatggtttaatagaaacaaccaatccgttaacatttaacataaatcaattggatattaacgaatatccgctcaatgaaaccaaactgttttcatttcgttatctcaccataaaacaaacctttcctataccttaattgttcattatataaacgaatttcacatgatatgagcaccaaagaacaatactggaaatattccctcatcgtcatcatcctatttatggggatcatcatcttccgacaaatcactccattcctgggaggattattgggagcactcactatttatattcttgtacgcggacagatgagatatctggtagaaaaacgaaagctaaaacgtagcctaagtgctttactgattaccgcagaaactatttttgtcttccttattcctttgggactgaccgtctggatggtagtaaataaactacaagatatcaatctggacccacaaacgtatatcgcaccgatccaacaagtagccgaatttatcaaagagaaaacaggatatgatgtattaggaaaagatacattgacattcattgtctccatacttccccgtatcggacaaatcataatggagagtatcagcagtctcgccatcaacctgttcgtcatgatctttgtactttatttcatgttgatcggaggaaaaaaaatggaagcatacgtcaacgatattctgccatttaacgagaccaatactcaagaagtaatccacgaaatcaatatgattgttcgttccaatgccatcggtattcccttgctggctatcattcagggaggagtagccacgataggttatcttcttttcggagcacccaacatcttattattaggattcctgacctgctttgcaaccattattccgatggtgggcactgcattggtatggtttcccgtagccgcttatctggctataagcggagactggttcaacgccatcgggattgccgcatacggagccatcgtcgtatcacagtcagataacctgattcggtttattcttcaaaagaaaatggcagatactcatccacttatcactattttcggggtagtcatcggtctgccgttatttgggtttatgggagtgatcttcggtccgttgttgcttgcgttattcttcctttttgtagatatgtttaaaaaagaatatctggacttacgaaataacctcccgtcgagatgacggaactaccgaaaaattgtgtacttttgccgttgtaaaaacgacactaaaatttgatggaaacatttacattcaatactgtcgaactgattcttttatcagcggcaggtattctttttatcattcagctcatctattattttggtctgtacaatcggatacatgcccataataaggctgtacgcaaagaagaggtacatttttcacgagaactgcctccactttccgtaattctctgcgcacgcaatgaggctgaaaacctgcgtaaaatcctgccagccattctggaacaggattatccgcaattcgaggtgattgtcatcaacgatgcttccacagatgaaaccgaggatatactgggaatgatggaagaaaaatatcctcatctttaccatagttttacccctgaaagcgcacgttatatcagtcataaaaaactggccctgacattaggcattaaagccagtaaacatgattggctggtatttacagaaacaaactgtatgccggcaagtaaccagtggttaaagttaatggcacgcaactttactccgcagactcaaatcgtattgggatatagcggctatgaccgtacaaaaggatggttgcacaaacgtaccgcatttgataccctcttccaatccttgcgttatctgggattcgctttagccggaaaaccatatatgggtatcggacgtaacttagcttaccggaaagagttgtttttccaacagaaaggattctccaaatacctgaacctgcaacgtggagaggatgacctattcatcaaccagttggcaactccttcaaatacccgcgtcgaaacagacatcaacgccaccacacggataaatcctgtgtaccgatacaaagaatggaaagaggaaaaaataagctatatggcgaccgcaagatattatcagggaatacaacgataccttttgggatttgagactttctcccgtctgttattctatgtttcctgtatagcaggcatcgcatccggcgtcctcaattctcattggttagtcgcaggcatcgcactgttaatctggttactacgcttcatcatgcaaattgtcgttattaaccaaacagccaaagaaatgggaggaaaccggaaatactatttctcattaccgctattcgaccttctccaacctatacagtcgctgaatttcaagatttgccgattctttcgaggaaaaggagatttcatgagaagatgaattcatggaatcaaccgttgcatataaatagcattcgaaccatcatgataatagcatggctttattcctgccggaataaagccatttttcatatatagcgcaatagcggcagcgttcgtcaccttcacttccaaagtaattttagcagccttacattcgttagctgtccgaatcgtttggtccatcaatgcttgtcccaatcctttccctctgaaatccggatggacagctatcgaatagatccttaaataatgagttccaccatggaataataaggagacataagcgattaccctatccccttccatcattacatagaaagttcctttcgagcggcttatcagataagcaaactgttctttcgaaaagctatcttcccgaaaacattcccattctatttccaaaatagcaggaatatcactttgctgtgctttacgaacaaataaacccgtctccatcatcaataatgtttcgcctccaaggcctgttcaaaatgattcagtaaccggtaatacatttcatcaccgataatggcatcttccagcccatggtcgatactcggattatcattgttctcaataacataggctttatcatctaccattttcaggtcgactccatacaatccctttccgatcagattcgcagctttaacggctgtatccaacactacccgaggtacctgataaataggaatcgtatctaccagtccgcaacgacttctgcccgaatcatagtggcagtaaatttgccaatgtccttttgccatataatatttgcaggcatacagcggtaccccattcaacaggccgacacgccagtcaaactccgtaggagtaaatgcctgcgccagtaagatagccgacttctcaaaaagcatcttcagacttgcttgcagttcttcctcattcgaaacctttttcatgccaatggaataagacccatccggtatcttcagaataaaaggagcccccacctgttcgctgatctgctcaaacgaatgatcgtttgactgaaaaatcagcgttgacttaggagcagaaattttttccttttcaaaaagttctttcaggtatactttgttcgtacaccggatgatggaaagcggatcgtcaataacggccattccgttttgtgcagccaattgcgacaaatggaatgtataatgattcaatgatgttgtagtacgaatgaacaaggcatcaaattcgagcaaacggatggcgtcatcttccgtaatcatttccacatgaatattcatcttcttggcaacttctgccaatttatgcaaggcacctttgttgctgggcggaaatttttcctgtggatcaaccaatacagctaaactataacgggaagctttcgccgacttaggcgcacgccatattttcttattaaagttatccaatgtgttggcaaagaaatcctgctcttcatcattgagccgattcagaggaagaaattgaatactttcgatctgatttctgggatgagtattcaaagccaccctcaataatgggcaagggtaattctcaaaaataaatcgtgcaatccgctccagacctttctctctacatttgccaaagtaaatgttcagataccaaatgtcgtctttgacattgttcttctgtatccactggtaacagagggcttgcagactacgatccatccgaacacccgtcccggtctccaacttgttgattatatcaacatccggaatgactttctgtcctctcgtttgggctaacaatgaacagtaatacccttcagagttataactgtaatcatcgctaagattaataactaacttccggtctttttctaccggcttgtttttcagatagtcggaaacagtcaggacactacttgtctcgtaatacggtttccagtcatccagattatccaacaggattaacacattattcataatggttaaaaattaaacctacaagaggatattaagtaaattgggcgcaaatatagacatattattcactccacatcacgcaacagactaaattatttatgcagtagaaaacgggtagataaaaagaggattattcgtatctcatggagcttgccggattgatcttggtaatcaaaaatgaaggaccaatcaacatcaatacagaagcaaacaaagtacccaaattaatcaagataaaaagtaaaacattaaaagataccgggacagtatctacataataagtctccggatcaagtttgaaaagtccgaattgagattgaagaatacagaatgccaaaccaatggcattgccccagagcatgcctttgccaatcagaaagactgcaaaccaaagaaaggttctgcgaatcgtgaaattattggctcctaatgcttttaaaatcccaatcatattggtgcgttcgatgataataatcagtaaaccggaaatcatggtgaagccggcaactcctatcatcaaaatcagaatcacccatacgttcaaatccaataaatcaagccaggcaaagatttgaggattcagttgttcgatgttacgcacataatacacacctcccagttcatcttgcctgttgtcaatatcagttgcgatctcataggttatatcttccagtttatcataatctttcacctgtaattccacaccggtcacctgttccggttgccaaccgttcaagcgattcaccagattgagatccgtcagtaaaaagaggttgtcgtattcggagaagttcgtctgataaattccggcaatcgtcaggcgacgagcacgaatatcatcctgtatataataggtatatatcttatctcccagtttcaacttcattttagttgccaacgctttcgagataagcacttgattggtagatactgaatcactgaaaacaggaatctccccttctaccaaatactcttttataaaatgggggtcgaactccggacctaccccttttaacaccattccttgaaaagcgtcatcggtcttaatcatacccggtttggtagagaaacgctgcacatggcttatctccggataatcagcaagagcagtcatcatactgtctcctaccacaatcggatgagtttcgtaagaactgacggcatccagattagttatctgaatatgtgacccgaatcctatgactttatttctcacctcacttttaaacccgataactaccgccaccgcaataatcatcacagccaaaccaatagcaatacccgccatggcaatgaggaccgcaggacgtgacacctgctttctgccatcgctttcacgatagatacgccgagctatgaaaagtgatagagacattgggttaagtattaagtataaagtattaagtattagacataaagtattagacaattatacacacgagcaaacacacaagaagctacggttaatacttaatacctaatacttaatacttaaatttcattctgttcttcccggatatgcttccaaggccttctgcaagacaaaaagcgcacgggttaaatcttctttcttcaatacgtaagcaatacgaacttcattaatgccggaacccggagtggtatagaaaccggaagccggagccatgaataccgtctgaccttcatattcaaaatcagagaggcaccatgcacagaacttgtcggaatcatctaccgggagtttcgctactgtataaaaagcgcccatcgggatgggtgaataaacaccgggaatacggttcaaaccgtcaatcaggcatttacgacgttctacatattcatcatacgtttcacgagaatactcttccggagcatccaaagaggcctctgcagcaatctgtccgatcaatggaggactcaaacgagcctggcagaacttcatgacagcatcgcgtatctccttgtttttggttatcaacgcaccaatacgaataccacattctgaataacgtttggatacggagtcaattaataccacattattctcaataccttccaaatggcaggcagagatataaggagaaccggtatatataaattcacgatatacttcatcggagaaaaggaacaaatcgtacttctttaccaggtcacgaatctgattcatttcacgacgggtatacaaataaccggtaggattgttgggattacaaataagaatcgctttggtacgctcattaatcagttcttcaaacttctctactttcggaagggaaaagccctcttcaatggtcgtagcaatggtgcggatctttgctccggcagagattgcaaatgccatatagttagcataagccggttccggaacgattatttcatctcccggattcaggcaggaaaggaaggaaaaaagtacggcttccgaacctcctgatgtaatgattatatcgtctgctgtaaggttgatattgaatttcgcataatatcctactaatttctcgcgatagctacgataaccggcacttggactatactccaataccttccggtcaatattgcgtatcgcgtcaatcgcggcctgaggagtgggcagatcaggctgtccgatgttcaggtgaaacacatggactccacgttgcttggcagcgtctgccaaaggagccagctttctgataggagatgcaggcatctcgtttccgcgaatggatatggttggcataattttaactacaaattacttaattactatttactttttctacttggagctgcaaatgtacgcaataatttgaatacagagacataaaaactttaaaaaccttagcaaggttaaaatcgttatggtaatttgaaaagaaagctatacatttgtcatacggaaaacttaaaacaatatcataatgaccatacaccttatctcatttgcttcaatccttcacaaacaagtctcgctacgtagctcacacgaagctattttaagcgaaattgaaaaatattataccgtaaagctcgtcgattatcaagatatggacaagcttagtagtgatgatttcaaaatcatttttatcgctaccggtggggtggaaagactggtcatacagcaattcgaaaacctcccccgccctaccattttactggcagacggcatgcagaactctcttgctgccgcattggaaatctccacatggttacggggacgtggaatgaagagcgaaatactacatggcgaattacctgctatcatcctgcgtattcatacactttataataatttccgtgcacaacgttccttattcggcaaacgtatcggagtcatcggaactccttcttcctggttagttgccagtaacgtagactacctgttggcaaaacgtcgttggggaattgaatatgtagatattccattggaacggatttacgaacaatttcaacaaataacggatgagcaagtcggagcgtcatgtgcggctgtagcatcgcaagctcttgcctgtcgcgaaggaactcccgaagatttaatcaaatccatgcggctgtaccgggcgataaaaaaggtatgtcaggaagaaaatctggaagcactgacattgagctgctttaaattgattgaacaaatcgacactaccggatgcgtggcattatctttattgaatgatgacgggataatagcaggttgtgaaggcgatcttcaatctatttttactcttttagcagtgaaagcgcttacgggcaaggacggatttatggcaaatccttccatgattaattcccgtacgaacgagctgatactggcacactgcaccgtaggactcaaacaaacggagagatacattatccgcaatcattttgaaacagaaaaaggaattgccatacaagggttacttccaacaggagacgtaacgattataaaatgcggcggtgaatgtctggacgaatattacttatctactggaacattgactgaaaataccaattatattaatatgtgccgcacgcaagtacgcatccgcatgaatactccagccgagtattttctgaagaatcctttgggaaatcatcatattatgcttcatggtaactatgaagatacattgaacgagtttttccaggcaaatgcttgcaaaagaactgaataacatctcaaaacatccttaaagaaagcgcctccttaataaacaaaataaattatcagtttattaaggaggcactttggagattgactaaattctatttctttattctatttctctttcttcccattttccgttatgccactctgcaactgaagtaaagcctgtcttcttcaaagcagctaatgcttcggagcgtccattattaatccgttccggataatgcgcatcactgtttacctgtactctgatacccagttctttcaggaatgaaaaatatcgtttattgggatagaatgttcctaaatcgtgataagatttagtatttatttcaacgatataaccatattcggcaatggcggtgaaatatttgcgaaccaacgcatcataccacggttcatccaataatcccggacgataacaggaagcattataatgcatcttgtcagcatgaccgacaatatcaaatcctcccaattctaccatacgaagcaggttcttatagtaaagacggaccacagaatccaaatcaccatcaaagtgcttgtctaccaattgacggaaaagatctgccggagtatcaatatctacgatttttccttccggagagtacaacatatgtacagaacctatccggtagtcaagtggtagtttttgaaaacagggtaaagaagggttgctttcttcgttcaggtaatctatttcaagaccaatggcaagctctattttatctgcatatttcttcttcagacgggaaaattcggaaaggtaatcatccattctatcccactccatcgtccatgcagtagaaaacggcagtggagcatgggaagaaatgccataggaagtaaatccttcactgatagcaaaacgaataaaatcttccatattggcgcgtccgtcacaatacaaacagtggctatgataattggttaggtttgtcatacaaggttatatgttgtccgggatatattatcaaagttattatcattatcaggctattctagtgatacaatgacacaaatcagccttctatttcactaagttccagccatcgcattgttttctcatcaatcaggtcattgacttcaggcaaacgtttcgatttctctgtcaattcgtcaacagaaagggtaccgctacataagagttcttcaatctgcactttttctgtttctaattctgctatctccttttccaattgctcgaactctcgcttttccttgaaactcatcttccgtttgtcgttcagacgaacacgggcggtcttttcttcctgcggcttttcagcttctttctccttttgagctttcgcgtctttccagtcacgatagtcactgtagtttccgggaaagtcgcgaatatctccctgtccattgaataccatcaaatggtctactaccttatccataaagtagcggtcgtgagaaacaacaatcacacaacctttgaaattttgaagatattcttcaagcacgttcagagtgataatatcgaggtcgttggtaggttcgtcaagcaccaggaagttagggttacgcatcaggatggtacacagataaagacgacgacgctcgcccccactcaacttatagacatagctatgttgcgtttcgggagtaaacagaaaatgctgtaagaattgcgaagcagtcagtttctttccattacccagttcaatcacttcggcaatatcctgcactacatcaatcaccttcatttgttcatcgaactgaaggccatcctgcgagtaatagccgaaacgaacagtttcaccaacatccaccgttccactgtcgggcgcaacctgccccattaatatcttgataaaagtagatttacctgttccgttatttcccacaatgcccatcttttcatagcgggcaaagatataagaaaaatcatccagtatcttcaagtcaccgaagctcttaaacaagtgatcggcctcgaatatcttactaccgatataggatgctttcacctccagcttcacattatcattgttgaaacgttgctttgccaccttttccaattcataaaaagcatcttcccggtaacgggctttatgcccgcgtgcctgcggcatccggcgcatccaatcgagttccgtacggtaaaggttgttggcacgttctatttctacactcttagcttcgatacgttcctgacgtttctcgagataataactgtagttacctttatattggtagatttgttgattgtctatttcgataatctccgaacaaacacgatcaaggaaataacggtcgtgcgtcaccatcagcaaactaagattggtacgacgcaggtaatcttccagccattcggtcatatccaagtccaggtgattggttggctcatcaaggataagcagatccggctcggtaatcaacgcattggctaaagcaacgcgcttcaactgtccaccggacagttgcttcactttttggtcgaagttgcggattttgagttgcgaaagaatttgcttggctttctgttcatattcccaggctttctcctgatccatacgcgccagaagattttccaatcccggatgaccttcagtctccatgcaacgttcatactcttttatcagttccacggtactgttaccgtgatggaaacaggcttcaagcacggtcaactcttcgggatactgtggatcttgttccagataatccacccgaaggtcacgacggaaaacaatgttaccgctatcataaccttcttttccagcgattatattcaataaagtagtttttccgctgccgttcttcgctatcaatcctacacgctggccttcagcaatgccaaaagatatattttcaaaaagaaccaagtcaccgaaagacttggtcaggttatctatctgtaaataaggtacagccacgtaatttagtaattagttggttagtgattagtgattaataatcacggatttatactcttcaataatgtcgcaaggttctccagcctttactttactccatgccagtttcaacggatcgatgatacggtctttatattgtaatacaggagcttcccggttaccgtcaatcaacgttttccattccataccttccacttcattcgtcagaattatacagactgtgatgccgattgccaaccattcctctttctttttcgagccaatcttaccgctattaatcacctgctgaagtttctccaggtcttcttctattccctgaaaatcttttttcaattcctgcttcacggtagataccacccattcgtacgcttcattaatcaaatagatttcagaaagacgggccgggatcagttcagcaggatacttctgcccttctttgcgtacctccaaagtagcgattacatcttccgcctccttcacaactccgcctttaggtacagtaaaagaacattcgaaagcaatatcgtcaactcctgtaatccacaaatgggaagtataataagtcccctcctcctgaaacatttctttgctatacgcacattcccacgttccgactttcaccaacgaagccgaatcattctctttcagttcctgccggatgacatctttaccataaccggcttttcctttaaatgcggatatacgaaaatttcccgtccatacttcgggattatagaaaagaaaagagccttcgccatcttcaaactcattccagtctgatggatagttcatagaaaaccatgctccgggagagataaatttcttgccttgcatccttttatattaaaaatgattacttgggcaaaagtacgaattaataatgaagaatgaagaacgaagaatgaagaattttgctgcgctatgcaagtataccgcaaggatattcttcattcttcatttttaattcttcattttcctatcggctgtattttcctccgcacttctttagaaatctccaaaaacatataattcaactttccggaatggattccttcttcgttttccttatacttcttattagcatactgcttcgatttctcgaaagtcagtaacgacatctcattctgcgatttgcctaccattgtagaatccagttgttcatccgggaaaaaatcatccagatcgacatcaccaatcatcgttgtctccagaaagtttttattcgtgtgcgaattatccgtatagtatcctacaaacatgtgccccggtgtacgtaccaagataggatcaatattaatggcgcgaagcaacgacgcaaacaacacactcccatccacacaattaatctgtgaagattccagtgcatcatcaaacgtacggacacgctgcgagaaaacaacattgctcgaaaggctggtattggaaacagaactataacggaatttacgtttctgcaatatattccaaagggcatatacctgcttgtctaccgcccctttagccttactttgataaccgagaaagcgattaacaatccgagtattcaatgcctcgcgaagcaactgatcgatcatcggattctcttcattgacataagccgcaaagaaaatactggtatcatggaatttagttccgttagccacataccccaacagacactcattgatgctacgcactgaaaaagtacgtacccgttgtcccaaatcttttccattcatctccactgtgatggctacgcttaccggttctgcctgcacctcatttttcagtgcctcataattccagatgatatcaggataaatcgtatattccgttctgggcttgtttaatacaaattccgacaccgagcgggagaaaaaaggcgtttcggctacttcaatccgcacacgactataagctgtcttcgatttcaaccgaacggcaatacacgacttcggatttcccaaagacgtcgaatccgacggaacaatcacttgtgcatcagtggtggcaacagacagaatcgccgaaggaaatatatttcctcccagatcgtctacaatctcaaaaccggaattgaatgaagtatatttaaacacagacataccgccaaggagaattaacagtaccacaacagatcctattatttccttccgatgtcgttttaagtcaatttttatcattatttgtagtttctatagtcaaacatttctattgtatctcgctaacaaagataacaaatagcgagcgttttttcctcttacaatcaacaaaaacttccatattccgtatcaattcccggaattcacagaatgtaacacgattgtaacgtctgtttcatctgcccgtaacaaagtctcctcatctttgcaaaggataaaataaaaacgtaactttgtcatatcacattaatacatatatcttatgaacgattaccgtattctagttgtcgacgatgaagaagacctctgtgagattctgaaattcaatcttgaaaacgaaggttatgaggttgatacagcaaattctgccgaagaggcaatgaagatggacatcagcagttatcacttaattctcctcgatgtgatgatgggagaaatctccggtttcaaaatggccaacatcttgaagaaagacaaaaaaacagcaaaagtgcctatcatctttatcacggcaaaagatactgaaaacgatactgtgaccggattcaatctgggagcagacgattatatttcgaaacctttctccctgcgtgaagtcattgcccgtgtgaaagcagtattaagacgtacggtaacaacggaaacggaaagagcacccgaacgtcttacttatcagtcgctcgttattgacatcacaaagaagaaagtaagtatcgacgacgaagaagtgccattgactaaaaaagaatttgaaatattgcttctactggtacagaataagggacgcgtattctcacgcgaagacattctagcccgtatctggagtgacgaagtgtatgtgctcgaccgtaccatcgacgtaaacatcacccgtttacgtaaaaagataggtatatacggcaaacgtattgtcacccgtctcggatacggatactgttttgaagctgaataagtaataataccgaattaagtaattattatgaacctgcctgtaactcaaaaacattttctttctttcagccggaagctgttcctttcggttatttcactctttctggtatttgccatttgttttattgcgtaccagtatcaacgtgaacgggaatataaaatagaactgctgaatacaaaactgcaagattacaacagcagactctacgaacaattggaagagcaaccccttgatagcgaaataatcagcggttatatcaacaaacatattctggaagacttgcgtgtgacccttattgatgcagaaggaaatgttgtttacgacagttatccaaatcataataaccaaatagaaaaccatctgaatcgtccggaagtacagaaagcaataaagcatggtaacggatatgacgtacgtcgtacttcggaaacaaccggagttccctatttttattcggccactcgttataaagattatattgtccgttcggctttgccttataacgtcagcctcatcaacaacctgcaagcagacccgcactatctatggtttaccatcatcgtgaccttattattaatgattatcttctataaattcaccaacaaactgggcacttccatcagccagctccgtgaatttgccatgcgtgccgaccgaaacgagcctatcgaaatggctatgcaatccgcttttccacataatgaactaggagaaatctcacaacacatcatccaaatctacaaacgattgcacgaaaccaaagaagctctctacatcgaacgtgaaaagctaatcactcatctccaaatctcgcacgaaggattaggagtattcacaaaagacaagaaagaaattctagtcaataatcttttcacccaatacagtaacctgatttcggactccaacctggaaacaacggaagaagtctttgctatcagcgaactaaaagagattattcattttatcaataagaaccagcaagaacgctcgagaggaaaaggtgaaaagcgaatgtcagttaccatcaacaagaacgggcggacatttatcgtagaatgtatcatcttccaggatgctagctttgagatttccatcaacgacgtcacccaggaagaagaacaagtaagactcaaacgccaactgactcaaaatattgcccatgagttgaagactcctgtcagcagtattcaaggatatctggaaaccattgtcagcaacgaaaatattccacgtgaaaagataaacgtattcctcgaacgttgttatgcacaaagcaatcgtttgagccggctgctacgcgacatctccgtactcacccgcatggacgaagccgccagcatgattgatatggaacgagtggatattagtgtactggtcggaaatattatcaatgaagtatctctggaactcgacgaaaagcatatcacagtaatcaactctctgaaaaagagcatacaagtcaaaggtaattattcattactatattccatcttccgcaacctgatggacaatgccatcgcatacgccggaagcaatattcagataaatatcaactgtttccgtgaagatgagaatttctactatttcagcttcgccgacactggtataggtgtatcacccgaacatctgaaccgtctcttcgaacgcttctaccgggtagataaaggccgctcacgcaaactaggcggaacaggattgggactggctattgtgaagaacgccgttattatccacggcggcaacatctccgccaagaacaatcagggaggtggacttgagtttgtatttacactggcaaaggagaaatagaggggtagctacattttaaaacatttcccgaatcattacttcggcttccttcatccaagatttctctcataacacgacaccttcattggtgacgttaatataaaaaggggggggggtaaatgggcggttctcccaaagttttttgagcgtgactatcgggctgatagagactccggttttcagttccagttcgtaaagtggcagtgtgatagattcttcgtccttcaatgtcattttctcgccgtcgagcaggataagcaggtcaatatcactgtcgctacgcgcttcgttccttgcttgcgaaccatataaaatagtttttgccgtaggagccacgcgacgtataatctctcttatttgtttcgtttcataaattttccatttattataatcaatgctacgggcaaagataacaattccggtgcagattgttctgtcaagaaccgattatttcccccggcacacaaagaaagattcgtttctctcatccggcagcaggctacagcagcggcgagtgaaaacgaatctttcatcttaaagggtcgtgcggcaatgccggaaggagcctttggcaatacagaaaagtccttttgcggtgcaggaacccgtcctttttatagcaccggaaaagcatccggctttatgctgccggatcgggagcctctcctcccccttcaccgccaccgccaccttcgctgggagtagtggattttccgccccattcttcccagaagatattggaatcgacgagggaacgggtggtaacctggttgttggatgaacggctcgtttcagggatgaagcggacacggacgccggtgatttgcttggcagtcactttgtcgggggagtccactccattgcccgaagcaacggctgtgtagtagaatgtgcccacgccgtcgagtttgacggtgcggccgtctgccatgtagctacctaatacgctgccaagggacttgagcacggcaaaggtgtcggcagggcttacggtggattcaatggcaagacgttttgccacttcgtccgtcgtgacaggtttgccaacggtgatggattgcggataccacattccattgattttctgttttactttcttgaagaatcccataagttgatgttttttacctcttccctgccgcatcccgataggactaatactcggtgacggactttgcttatctcggtgacgacctttgcctacctcggtgtcggacttagcctacctcagtgacgacctttgtctgtccgtgtctgcaagcatttcctgatggggtgctgcaagaaggaagcgtgattaataaatgttgcgaattatctcaattatcatatttgccgttcccctccgtattccgccagcgcgcaaagcagttcgcccagtgcaaggccgccgttgaaggctgacacgtagttctgcgtgtcggtcacgtcctcgttgaaatggttgagacggtcggtgatgggggaaagaaagaggataggttcgcctgaggtgctgatttttaccacgccgtgggtggtttcgatggagtttgccgtatacccttcgggggctgcagcggcaaattctttaagggcttgggcgtctatcgtgtcgtatgaaccgtagtcggtgacgttgacggagcctactgccgtgaaggtggacgctccttcacacacgagttgcggtgcggggaagttgggcggcgggacaagtttgcatgcgccgccggggtaacagtgcaggcgggcgttgacggtttcggccagactgaacacggcaggggctacgttggaagcgatgaaggtgcctacgcggtcgtcgataaggttgtgttccggatcggcatggctgtcggggtttccgtcgtggataaagaagttgccgccgaggacaacggttccgttatgggtcactgccgggtcgggatagttggcggtgctgacgctgatgatgaggtcggcggcatcggcagcaatggcttgcgggagcactttgtatttttcgagggaactcgaagtgttgactcccgttgccataaggtcttcgatgcagcggactacgacttgcaacggttcttctccttctcggggaagggagaagacagcacggggttggctcatgcggttgtctccgtcgcacggagtgtttatcacttcagggaatggtaaggcggcgggacgcagtttggggttggtcagggcgttgagcacgggttccgtttcccagtttttgttgatgatgacgagtatctttttcataagtgtgatgttttttatggttgttaccttgatcagttgcgtcgcttccggcaattgctcctatcgaggaaggtatcctataaagagaagtgatgttcgcttctcaagtcggcgacaagggaaaaaggacaaggttcatgatattgccgccgactgcatcccccagcggcttgggacgtatatgatgtagggggacgggatggagtgacctggataccccgtccccgtgtgtcattcttaaaaagcgaggatggggcgcacggcggaatcggagttgtacctgacattatgccagcattgcacaacgttcgcctgcttacccacaaaccacgtccatatacccgaatcggagtacgtcgaggaagagaagaatttctgatagctcccattcgggattgcgtcatagttcccagtgcccaacggttcgaaataggcatttatcttacttacgagttctgtctgattactccatctatacaggttgggggttaggtcgttgccttcgtttatggcgtcatcccagcttgggagaccgcccagattggcggtaaagtcataccattgacctatggagggcaagtaccaccccgtcgtcttttcgggagcctgtacaacataatccttcacggccttgaaagcgggataaaaattttcgagttctttgttgtttgcggccgcatagtcgattaccgtggtgtaattaagtagtccgttgatgtctgcgttgcaggcaactttatccgtgcatttcgtcagctcggagaaatcgtgatcttccccccaactcataaggcttttggttacggtcttcaatgacatgaccagaccatgcggcgtggcaacgccttttgctgccaacacctgtttttctttgtcgccgatgcgcgaggggtcggtctggaaaacgatgccgatgcaggtcttgttcgcatcgagggcggtagaccatgtgccgtctgcataatagaagtcacccaccttaacgatatccgaaatatccgttgcatcctgacttacccagtcagtggtcatatctacagacaaagttaccgccggatcgtttccgactgtaatcaggtttccggcagcccgtacccagttgttgcgtttcagggggatgttggcaggaatgtctctatcgttcatcgttatgctacctgtcccggtaaacgtaagttttattccgcccaacgtggcgtcggcagtggtaaagacataatcggagaagaggattttgcagttgtttccattgatagtaatatccgtgccgtccattgaggttgtgatgtaggtggcatcgtaggtagctgtcgggcttacctcctcgctaaaagcattgaattctgacggaacggtgtatgttgccgtcatgtctttacatttgcctatcatctcggtgttcttttccgcaatcgtcactttcgtaagcggacggacaagcgtggcggtaaggtcgttcttagccgtagcgcctttggtgaacggtactactgccgcaaatgcctcacgtagttggtcggcgtatgtataagcagcggtgatgatagtcactttcttcaagccatcggcattatcagtcttgtaatacttatcgggatagtggtcgcctgacaccgttgcacccgaaacgatgtaatccgcccaaagcacggctttgtagtcaccttggtctgccaattcaaaactaaatgtaatgttagcggcaccagccgttaccaactgctcctggcgtactcttcgtgtagagccatctttcgtccacacttcgaggatgcagcgcagcgtatggccggcgggaaacgtagcgggggcggaagcccgtgtttttacaaaatcggcaggcattccgatgctcatgcttacttggttgctgtccgcagtcggggaagcgtcggtgtcgtcctgactgcacgaggtgaatagccctgccagagccattaacccgaagaaaaggttctttttcatacttctgttcatcgtttactgtgattaaatttgttttattatattgacctgtcatttcagaaagaatcgaggtcgatgtctatctcgtcgtcatatccggtgtcgatgttgatgcctccctgcatttcgttggtgaggaagttgcctcgcagggtggtgaggtgtccccgccggtagggcacttccagtccccgggtacgcgacactacctttccgttggcgtccgccaattcaatattcaggggcacaaaggattccgtgccgttcacgaagataaagtccgaacctagcggacatttctccgtgccgtcgtcggggatggtgagaggggtggagaacgtcacgccctgcacggagttcatcggcttgcccgtggcggtgttgaatcctaacgggaaatagaacccgtaggaaaaggtgacggtgtaggtgttgttgccgccttcggcatcgcgttgccgctgtgtttttgccagaaactcctgcacgtcggtggcgataatacggtattttgccaacgggcgcaccatgtcgactttggcttgtacgcggacgttccattcgtcccggtaggggcgcaggtcaagggtggtgctgccgtagaggcaatcgcggtagccagtgcttccggtgtagggcgtggtgcaagttacttgctgcaagttctccgtattataatagaggtcggtggtcgtgcctgccacaacgtagtccgtccatacggcgagggtgtattctacggcgtacagcttcaaatggacagggagcgtgattttcccgttgccggcttcgtcggcattgtccatgacggtcacttgccgggctgccggtttgccgtcgcgccatgcttcgatgatgaagcggcggcggtaatccgtttgttctccggcacgggcttttgtgattccgcggtgtgccttgttggtgatgatttccagtggtaggagttcgaggtcgagggtcacttcggtactgacctctacaagcgtggggtcgatgccttcctcaccgtccggtgtcatcgcgggatagtcgtgtacacaagcggcaaggacggttgccaacatgaaggtgataaatcctatagcatatttctgtttcataagccgttactttttaaggttgaagcgatagacgatagaaaaccccatgcgggtgatgccccagtagttcttcgtccgtgtgtctatccgtgcgccgttgtctatattataataggtgtcgtacttcatgttggcatagcctgcaccgagggtaaattctcccgcccaatgtccgccgagcggcaacagataaccatagctgacgcccgcgcccagcaacggacggtcggcgtcttgataacggtcgcgattccacttcacattgaaccagcctacgtgggcatgaagaccgaagaaatgtcccgagccgggcttcgagagccagtaacgggcttcgggttgcagggtgaaggtcttcacggcatgtttgccgctgatgtgccacggacaccacaatatcggcaactctacggaaagatgcttgccgacctgcacttccgccgccacgttcataatcgtgcccgcccaagcggcaaggttggttttcacgccaaggtaacgaccgttggcgggaagtgaaggcgaggtagctgtagaggtggaagcggtggaagaagaaggagtaactgaagcagaagaagcaaccgaagtagaaagagcagtagctgcatcgggtgcaacaggtgcagtagctgcatccggcacaacagccgtggcagccacggcggaagagtcaacaggctctttgtctccctgcaaggcaaccggaagggcttcctgttgttcctgtcgcctcgccgcacttgcaggctcttgccggttttgcggaatctcgctttggcaatcttggaaacctcggcaacctaccacgacgacttctccccacaagggatgagccaacgggtggttgagtgtccggaaatgccgctcgcgcagtccatagtggtcgataagatagcctttcagattgttggcacgccagtaggcggcgcgcagattcgacttttcatcgtcccaactgccggaatagctctgcacgtagagggtgtcctgacgtttacgaaaggtgcgcagccgtttcttcaacttccgcaacgacagtcggttgtccgcatattccgtcttgaacatccggatacgtgaaggatagctgaaaataatcaggctgtctgccgaaggtgaggaaaggacggcagcatccggctgaccgcgcaagggaacaaccgatagacatagcaaaaatgccagtacgaagtaacggaatgtactccacgctacgttttgtttgtttttcattctcatacctgtaacataagattacaaaaatttatatacaagaaaggcgtaagtgtccgtatgcttatccgtcaatcggggccttcgcactgcccataccgtagataagcaacagaacactcacgccattggcgtatataaagcttgtgtatcgtccccctcccctctccggacggagggggaagcgggggcgcaaacaggcatccatataaacaatggaacgtgagcatttgttgcattcatcttcacggtgacaagtcaaaggtgcgaagtttgattgacgaagatgatattcttcaaacgctttccgttatctaaaaatcacgccctctctcacaagggcagtgacaaagataaagaaaagccgaaaaacagcaaacaatataggctaaacttttattcgccggggcaaaaataattatttcagcccgacgaaggacaaaatgggaatggacagattcatggacaaaatagagaagaggctgtcaggaaaaggcttggcgcatacaaacagtaagggcgacccgttttttaacgagccgcccttactgtttgttatctatcttttcacaatgcctcaatttcttcagcagtgagtcccgtacattctgaaattaaatcgatagccaaacctttggatttcatcatacgggcggacgattcttttcctctcaacatacctttctgttcggcaaagtccaacgtattgaaataatcgttataaactttccattccttctcatattgagctctttcctccggagtcatattcgctttggaggccatcttctcaagtcgttcaaaaacggctttacgtgccttgaaaggcattctatcaagtgtatccatatgctttaatacataaatccaccgttcaaaatcgttactacactcatcctcttctttgtcaaagttaggcagttcgataaaaatctgccgaaacttgttattgaaaagctgtcctgtatcccggtcggaaaggattacatcagtccttatcttcgcaggcatgtccttgtcaatcacaaagttcataaaaaacactccgtatacagcatccaaccggaagtcccaaggaccgcttttagcttgttgcgtaatcgcacgagagaggtagaagagagcacgatctttaaagtaaggttgctcacgattctgcatttctacgattatccgttcacctgtgtcagtcatacagtagatatcgtagataatcccccgttctgtttttacttccggctgctgttcgttgttaaggaactggatgtcggtaatcacgtgctctccagagagcaaatcgttcaagaagtcgattaataactccttttctacctctctgccgaataaaaacttaaagccatagtcggtaaagggattaataaatcttcccattattaatgtattggttgtgtatattgacaacaaagatagacattttttgtttaatgatgaaagttccgggttaatattgctgaatgactggaagaaccgattctataaatcttcccctgccataatgtgacggatttccgcatcagtgtccgaaccttcgggcagaccaagcttcacacggatgcggtatcgggttttggacacacttgccacgctgataccgagcgtccgcgccagttcttcgttggattgtttgagcagaaccaacatacaaaacagttcctcgctacgtgtcaccgccggacaggcttcacgaagatgtagcagcgccgacggatagacggacaaaaaggcgttacggaaatcctcttcttccttacgggtgagcaagtgggattgaaggctttccatcacgctgtcaagttcgcacgtgttgcggtggcgcgcctggatatcagaaagctggcggataagggagcggttgtgttcgtacaagtcctgacgggcggctatcagttcgtgaagcctgctttcctgatcacgcaaccgttcgtcagcccgctcatgttcctgcgcctcgagctgccaccggagccgcagattgcggtggcgcatcaccatccagccggctataaaaaagacgagtagcaatgcacacactccggctatggaatatacatgcaacagggtatcctgaagacggacttcggcagtcagcagacgattctcctgttctttcttctgtgtttcgaaacggatatttgccgatgccaactggtgtatcttgtcttcgcgggtcaccgaatctctcatcatccgatattcgggaaagacagtaagcatatccaccgcccgcctcgtgtggcgatagccttccattaacaattccgccgcttccgaagcagggtgaagctcggatatatctttcaactcgccaatagatttccgaagcagggggattgcctccaaccatttaccgacgcgggcaagagtggcaccgtaataatagtcataatatggcaggcggtgacggggaactttaccttcaagtgcggcaaagcctctcaaagccacattcacagagtcgggaaaggcggcaagataatacatccggtctatctgcaccatcaaatgatagtagtcgttcttcgtccggtcaaagcaactgtcggcctgcgcaagaaccaggagtgcggaatcggggcgattcagattgttgtgtatctccgccttcgcaatgaagaaacgacctatcaagttattgtcaacttcggcacgtgccggctcgcccgttcctacggcacaatagcgaaacgcttcatcatagagcccgagcaggcggtaggcttccgtcagaatctccgccaccactagcttgccgtgatagctgcccgacttctcacatagacggatagcttcacgacagagggagatactttcttcatacttcccctgctgaaggtatatatcggcaagccgcccgatagcttgtggataaagccaatagttgcttaggcccgagcgttctgccactcggcaggctctacggaaagcggactcggcacgagtgctgatagtgtcgacacccatataggtgatgcctgccgtagctgtacaaaatatctcgctcaacgggtcgttgttctcatctttcagtgccatcgcccggttgagatagtccaccgcctccgcatggcggtcgagcgccataagcatctgcgcctttaccacccacagttccctgcggcaataacgggagacaacggggtgtttcgcccgctccaacgaatcaaaatactgatagccggactcaaagttcatcatcagattgaagtatatcattaaccggcggagagattcggaagataaacggcgcaattcttcggtagtgagcacatcgtccaccggaagccggaacacggaatcaagcggcgggaaagccagactttccttctcctccttaatcaagcggataccacgccccaatgtacgaagactgtcggcatagaatgtgggagaaacggcaggatgttcccgctgcatgtcagaaggtcggttgcaactccacacagccgtcagcataaaaaaaacgaagaatatgtaggtggatttaatcatagatatgcattgtatgtttgtttgccgacacaaatatagcattttcattaaaacagtgcattttcacacatagtttttttatctttgctcaccaatagtaaattgaaaacaattcagcaagttatgagaacaaatataaatcttatcccagtcttctgtattctactgctttgcgcctgcaaaagcgggaatgcatccagccaaaactccaaagaagctcccaaagataccatcacctcctttacgctacctaccatcccgccaatgctgacagcacccgagctacgggcagatttcctagtaaagcactattgggataacgtaaactttgccgataccaattatgtccatcatcccgaagtgaccgaacaagcttgggcagactattgtgatatactgaaccatgttccattagaaactgcacagcaagctatgcagaaaacaatcgaacggacaaacgtggataagaaagtattcacttacatcactgatttggcagacaaatatctatacgaccctaactccccgatgcgtaacgaagagttttatatccctgtactggatgccatgttggcttctcccgtactggaagaaatagaaaaggtacgtcccaaagcccgtcgcgaactggctcagaaaaaccgtatcggaaccaaagcactgaattttaactatacattagcttccggcacacagggttctctttatcaacaaaaatcggactataccttattatttatcaataacccgggatgccatgcctgcacggagacaatcgaagcattaaaaaacgcccctatcatcaatcaacttctggaacaaaagagactaacagtcctctccatttatcccgacgaagagttggacgaatggcgaaaacacctaaatgaattccccaaagaatgggttaacggatatgataagaccttcgctatcaaggaacaacaactgtatgacctgaaagccatccctaccctctaccttctaaacaaggataagacagtacttctgaaagatgctcccgcgcaaaccatcgaagaatacctgctaatgaaaggcgaacaataagcccccacgccgcccacacacgtgcccatgccacaccgctcacgccgcatggtttcccggcctcgttttttcagcgtcaagcgcaggtgttttcttcggcgtcaaaaagggcagactgtttgagcgtagcgagtttctgccctttagccgaaggaagcaccggagtagctgaaaaaacgcagccttgattctttctttttggaaaaaacaaataaactccctatctttgtcgcgcattggtttgcgactcccatgcgggggaagcaattaaaagggaatcaggtgcaagtcctgaacagtcccgctgctgtaagttccatataagttacaagcaattcactcattgccactggagaccaatccgggaaggcgtttgtaacaggaataagtcagaagacctaccatgcaaataagtttcactgctttcgaggaaaaagcgttgagtctaatgaaccggacaagtcgtctatcatttcattcatcactctgattcagagaaagtgtgttaaaacggataaactctgccaagtttatttatgcgtgtccggtcgaagggatttcgcccggacacttttaaacagtaacagactgaaaaaggaataaatgaagaaaagaacatttaataaagtgatctttgcagcattcagctgccaattcttatccataccactttttgcacaacagcaaaaggtagatacgacacatacatattctattcccgaaataacagtatcagatatctatcagacccgcgaagtacgctcaaccgctcccctgcaagtcttctccaaagacgccctgaaaaacctgcacgccctgcaagtctccgacgcggtgaaacactttgccggagtgaccgtaaaagattacggaggtatcggcggactgaaaacagtatccatacgaagcctgggagcccaacataccgctgtcggttatgacggaatcaccctgaccgactgccaaaccggacaaatagatatcgggcgtttctctctcgacaacgtagaccgcctttctctaaacaacggacaaagcgataacatcttccaacctgcccgcttcttcgcgtcagcaggcatattgaatatacagacactcacgccgctattcaccaaaggcaaaaagaccaatatagctggagctttcaaaaccggctcctggggattaatcaatccctccctgctactggaacaacaattcaataagacatggagcatgtcagccaatggcgaatggatgtcctccgacggacattatccgtacacactacattatggaaatgcggcagaagacttgtcctcacgtgaaaaacgaaagaatacagacgtacagacattccgtgccgaagccggactttacggcaacttctccgataaagaacaatggcggttgaaagcctactactttcagtcctcccggggactacccaaagctacaaccttctataacgaccattccacacaacacttgtgggataaaaacacattcatccaaagtcaatacaagaaagaattcagccggcaatgggtgttccaaacctctgccaagtggaattggagctatcaacgttatctggaccccgataccaagaactctttaaagaaaacagaaaacagctattaccagcaggaatattacctttccgcttctgtactatacagactgttgagcaacctctctttctcactttccacagatggaagcatcaacaccatgaacgccgatctagccaactttgtacaccccacacgttactcatggctaacagcattcgccggaaaatacgtaaatgactggttaacaatctccgcatccgcattggcaaccgttatcaatgaagatgtgaagaaaggcggtagtgccggcaatcaccgtaagctaaccccttatgtaagtgccgctttcaaacctttccggcatgaagaattccgtgtccgcttcttctataaagacattttccgtctggcaagtttcaacgacttatattacgaagaagtaggcaacacccaactaaagccggaaaaggccaaacaatacaacatcggactgacatacaataaaaatgtatgcccgttcctaccctatctgtcagtaaccgttgacgcctattataacaaagtgacagataaaattatcgcctaccctaccaaaaaccttgccgtatggagcatgaagaatctgggtgaagttgacatcaaaggcattgatgccacaggaagcctgtccctccaaccttgggataaaatacgcatcaacctctcgggtaactacacataccaacgagcattagatgtcaccccgcccgatccgaacacgtatgaatcgacatacaaacatcaaatagcctacactccccgcgtctccgcttcgggacaggcaggcgtcgaaacaccgtggatcaatctgtcttattcattccttttttccggaaaacgctatgcattaggacaaaacattgccgaaaaccgattggatagttatagcgaccacagcatttctgcaaaccgtgactttcagatcagaaaaatcactacctctttcagcgtggaagtattgaacctgatggataagaattacgagattgtgaaatatttcccaatgcccggacgatccgtaagggcgacaataaaaataagatattaactattataaagtaagatattgacgtgaaaaggaaactaatatatatattctcgtgctggctgtcatccataatcttattcgtagcatgtgatgatatggaggacaaacccttcacatcaggcattataggcgatccgacagaaacgggtaccgccgaattatatgtattatgcgaaggactgttcaatcagaacaatagctcgctggcacgtttttctttcggcaaccagcaaatggttcgtgactatttcaaagcagtcaaccgccggggattaggagacactgccaatgacatggccatctacggaagcaagatatatgtgatagtcaatatctccagtacggtagaagtgatagactttcgtacgggaagctcattgaaacagattcaaatgctggcagaaaacggaagttcccgtcaaccacgctacatcgcttttcacaaagaaaaggcatacgtatgttcatacgatggaaccgttgcacgtatagacacaacctccctatccatagaagctatcacatcagtgggacgcaatcccgacggtatttgtgtacaaaacgaaaagttatatatttccaattccggcgggttggactattcatcaggactggtgggggtagacaacacggtatctgttgtcgatattgccacatttaaagaaagtagcaaactaacagtaggcccgaatcccggtaaaatagtagcagggccggacgaaaccgtttatgtagccacccgtggcgaagatgtagaagccggcgattataacttcgtcaagatagactgccggacaaacaaagtcactcaatctaacgagaaagtacaaaactttgccatcgatggagagattgcctatctatacaattacaattataacacgcagacctcttctatcaagatgttcaatctgaaaacagaagagacaatccgtgagaatttcataactgacggaacagtgataaaaacgccatacggcatcaacatcaatccttacagcaacaatgtatatatcaccgaagcccgtgattacaccacctatggagacttactttgtttcaaccaacaaggacaactcatgttccgtctgaacaacatcggacttaacccgaatacaattgcattcagtgacaaagcctcacaaagcgatattgatgacaacgatgatgataaggaaaatcctctggccttcgccaataaagtatgggaatatcgccctgctcccggacagtttatcaacactaccacttcagcatataagaaaggctttacttatgatgatatactagaagaagcaacccgcagaatccagcagaaatcactccttacattgggaggattcggcggttacattgttttaggattcccacaatccattccgaatgtaacaggagaatatgacttcaagataaaaggcaatgcttactataactccaaaaccggaacaggagcattgggcggaagtgcagaaccgggaatcgtatttgtatctaaagatgtaaatggcaatggaaagcctgacgacgagtggtatgaattgaaaggaagcgaatacgggaaagacactgaaacacgcggatacgagataacctatcaccgtccgaatccagccaacctaaaagttttttggaaagacaatcaaggcaacgaaggatatatcttccgcaacagcttccataaccaggaatcatattatccactttggatagaaagtgatgaaatcacattccagggaacacgtctaaaagataatgccgttttagagaacggattatgggtaggatattgctatccgtggggatatgcagacaaccatcctaacagcaaggaaggaagtaatttcaagatagattgggctgtggatagtaatggcagtccggtagacttggatcaaatcgacttcgtgaagattatgaccgcagtcaatcaggatgcaggacaaatgggtgaaatatcaaccgaagttaccaccattgagaacttacatttcaagaaataatcaataattaattaataactaaaatcagaaaagaacatgaagaaattatctttattattactgttatcagtatttgtattttgtggctgtagcgatgatgacgatacaaaaacatacgtgcttagcctgcccaattacgaaactcatacacttgatatgggcgatcaagaaaatccggatgattcatggtctgttagtagcgactgggggacaactaactacaaatataatctattaactgacgctagtggtatctttgaatttgactgtgtatcttcaacatacggtttctattcagatagttttgcatttacaaattgtacagaaaaagattgcccagacttcgcaacttatgattatcgcgctatcactaaaaaaggagtaatcaataatacatacgttatcgtgggagctgccggatataaaattggaaagaattctgataaagaagctgcaatccgtttcagagaccacgacaattcaaacaaattggaatcctatagagtaaaaggactatatttaacaaactgtgtctatgcttacaatagtatgaaggaaggtagttctatattcgaaggaaaagataaatttggaaatacagattctttcaaaatcatcatctataatatggataaaactcaaagtgtagagtgcactttaggtgaaggaacccaatttgtaactacatggaaatgggtagacctaacttcattaggcgaaacagagggattgaaattcaatatcaagaccaccaaagaagaccaatggggtgcaatgaccccaacctatttctgtcttgacggtatcactattgaagactaaataaccaacttgtttgattggttgagattaaacatcaatcgaccgcataattttaaagggccggatattcttttaagaaatccggctctctttctatctactcactacattttgatatattaccagcccatagagaagtaaacccaataactctcactaacaaaaagacactatatatttgttaatcacacaaattttagctacattcgtcgttcaaaactattaaatctacgacaatggaattaccttttgctgaatcatggaaaataaagatggtagaacccatccggaaaagcacacgtgaagaacgcgagcaatggattaaagaagcacattataatgtctttcaactcaaatcagaacaagtttatatcgatctcatcaccgattccggaaccggagcgatgagcgaccgtcaatgggcgggaatgatgctaggcgatgaaagctacgccggagcaacctctttctttaagttgaaagagatgattacgaaactgacaggatttgaatatatcatacctacccatcaaggacgtgccgcagaaaatgtgcttttctcttatctcgtgcatgaaggagacattgtacccggcaactcacattttgacaccaccaaaggacacatcgaaggacgccatgccaccgcattagactgcactatcgatgcagcaaaacatacccaactggaaatcccgttcaaaggaaatgtagaccctgataaattgcagaaagccctgacagaatatgcagaacgaattccttttatcatcgtaaccatcaccaacaatacagccggaggacaacccgtatccatgcaaaacctgcatgaagtacgtgccattgctgacaaatacggcaaacccgtacttttcgactctgcacgctttgccgaaaacgcctatttcatcaagatgcgcgaagaaggttatcaagacaaaaccatcaaagaaatcacacgggaaatgttctctctagccgatggcatgacaatgagtgccaagaaagacggaatcgtcaatatgggtggatttatcgccacacgacgttcagactggtatgaaggcgcaaaaggtttctgcgtacaatacgaaggctatctcacctatggaggaatgaacggacgggacatgaacgctcttaccatcggcttggatgaaaacaccgaattcgacaatctcgaaacacgtatcaagcaagtggaatacctggcaaagaaactggatgaatacggaattccttaccaacgaccggccggaggccacgccatcttcattgatgcacctaaagtactgacgcacgttcccaaagaagaattcccggcacagacgctgaccatagaactttatttggaagccggtatccgtggatgcgagatcggttatatcctcgccgaccgtgatccgataactcatgaaaatcgttttaacggtcttgatttactccgcctcgccattccccgcagagtatatacagacaatcatatgaatgtaatagccgctgctctcaaaaatgtatatgaacgtagagaaagcatcactcacggagtgcgtatcgcctgggaagcgcctttaatgagacatttcacagttcaattggaaagattataaacttagaaaaaataacaaatatcagttgaagaagtaatagaaagggattgaaaagaccagtgccagtatgaacgggcaatactttctccattaacaagaataattgtttgcataaaacaaaagtgtttcccaagtgtttatattataatcgaacttaatacgtaaaattatggcagaagattataaattaatagacaacgaagaaaaacatcgatatgaatttcagatcgatggcaaaatagccgaaatagactatatcaaatcaaacaatggagaaatataccttgtacatacagaagtacccgcctcattaggcggcaagggagtaggatcacaacttgcagaaaaagcactgacagacattgaacgacaaggtttacgcctggtaccgctttgcccgtttgtagccggatatattcacaaacatccggaatggaagcgaattgtaatgcgtggtattcatattaaataaatacagatatggaaaagaaaatagaatacaccaatggtgaactgaccattgtatggaaaccggaattatgccagcatgccggaatatgtgtaaagatgctacccaatgtctatcatcctaaagaaagaccctgggtgcaaatagaaaatgcgactacggaagaattaattgcacaaatcagcaaatgtccgtcaggagcattgagctaccgacttaacaaaaaagagaagtaaaccaaccataaaagaacccgtctgaaaagccgtgagttcataaaatcatgagggcgtccgaatataaagtgaaccccgaaagtcatacaaaaactttcggggtttattttattatgtcaagacatcacacattacaaagaaaagaaaaacaggtagaagcactccatctcttctcctattcaactcaatgtccacgtcaatacaaagtccagacaaatacgataaccgacagagtaaagttcctgctgctccgtcgccaactcctgaacctgaaacgttccttgctcttgaggaataaaatgcgtcaaacggagtttacgaagatcagcgtccgcgttttccatccgcttaaaaacagcttcctttgccgaccaatgcaataacagtccccaagtcatatcgtcctgataaggttccgtttgttcgtcagaacggatataccgatcagataccttgtgaacgcgttgagcatattgctcaatatcaatacctgccggagtgaaagaagcaagcatcacagctacataacctttcgtatgagaaatactgatgaaaaaagaatgatccgtcagataaggttttccctcgggagaataaccgatttccttatcctcctgcaacatggcatacaacaaaacacgaacggacaaccattccatcttacgccgttcggagacaaaacgattcaattcctgttcacagaacactcttcgcgcatccggcaaaagagccaacagagcatccaaagactcttccatcttccagacagcccactgtatatcatccgtcttatgttgcagaaataacgccatcttacgtttgcttgattatgctttcaaaattatgattccaagattattccttctctaccgagccttccatatccttcggcagaattgtaaacttcactttcaggatacgacgactatccatttcgagcacttcaaactcataatggtgataagtcactttctcatgcaatgccgggaattcacctttaatttcgagcagcatacccgccaatgtatccgcatctcccaccaccttttcaaactcgtcttcgtctactttcgcaatcttatagaaatccgtcaactgcgtcttcgcttcaaatatccaagtatggtcattcaagacaacgtatgtacgttcttcatcatcatattcatcatgaatctcacctacaatctcttcgataatatcctccatcgtcaccagtccggaagttcctccaaactcatccacaacaatggcaatatgaattttattcgcctgaaagtcacgtaacagatcatcaatcatctttgtttccggcacaaaataagccggacggatcaatgactgccaacggaaattatcccccttgttgacatgaggcagcaagtctttaatatacaatacccccttgatattatcccgcgaaccggaatagataggaatacgcgaataagcattttcaatgatacattgcatcacctccttgaaagaggtacggatatccagatcgaccatatccagacgtgatgtcatcacctccttcacagtttcaccgccgaaacggataataccctccaagatattattctcttcagagagttccgctttatctgtcagctccaatgcgtgcgacaattcatcgacagaaatattgtggctcttctttacaaaatgtttattcagaaaagtggttgaacgtacaagcacagtagctatcggacggaacagtttttccaggaagtaaatccccggtgccgaaaaacggcaaaaagccaaagtcttctgtgctgaatagattttcggcatgatttcaccgaacaacaacaataggaaagtcaggatgacggtcagtatcaagaactctgccaatggagaatgaaaaacaaatacattcataaagaagaagttgcagagcatgataatggttacattcacaaagttgttcgtaatcaatatcgttgccaggaggcgttctgaatcccccaacagggcacttattttttcgtcggaaggatgattctgttcatcaatatcattccggtcggaaggagtaagtgagaaaaaagctatttcggaagccgaagcaaagccggaagcaagcaggagtacacctgccaatactatggcaataatagcagagatagaaggagtgtttacggtaataccgttgaaaatgtcagccaattggcttaaataaccatctgagtccaaagagtctatattttaattaaacaaaagataatgtgccaagaagctcgcgaaaacctattggcacactatcacattatctagaacggcaaatcatctgtcggattatcttgtgcgggttgtgcctgcgactgctgcgcttgttgcgactggccggcaaccggttgttgctgttgccccgtagccggttgtccagtagcagaagctcccgcacccggattggctcctttcggagacagcatttccatattatccacataaatttcggtgatatagcgcatagcacccgactggtcgctataagaacgtgttcttatctttccttccagatacagtttgtcacctttgtgcacatacttatccacaatctccgccaaacggttggatgcaacgatattatgccactctgttctttcgggaatctgggttccattagccaacgtatatccacgatccgttgtagccaacgggaaagttgctactgccgaacctgtatcgaagtattttacccgaggatcttgtcctacgtttcctatcaatatcactctatttactgacatatctgtatcaagtttatgattcttaaaattaaatctgctgccaaaattaaacagaataacaataggatgcaagattttaagtataaaatcaagtattaagttttaagtattaagtattaggctgcgccataaactgcatgggtaatactcaatacttattacttaatacttattctaatgcttattctaatgcttgtagcaagtcttgtactaatttagaaacagcgtattgctccagttcgtccacccttattttcaggaaatcactgaaagaagtcaaattttcagacaaggtcacttcatatagattagcatagataacccggtgagacaatacatgcttcacctccctgcaaaccgaacgtaccaccggtacttcccccggcgcaaagagtgcacgaaattccggtaaagtcaaaaaatcttcttccgaaagagccgtcggagtttctatcaagggcagttcgaacagatttttccaaatatcattgcccgtccgtttatttataaaggtatacgcgcccgcacgtacataaatataattaaagtaacggttcgttgtctttgttttgtgttgcttcaccggaagttttgccaccaagcctttcgaaagtgccgagcaactgcccaccaacggacagaacaaacaatcaggcgactgcggagtgcactgaatcgccccgaaatccattattccctgattgtaaacagccggatgcttcttatccagcatctcatccgccaatgctgcaaagagcttttttccttctgtcgaatcaatcggagtatcgatgccgaaataacgggaaagcacccggtacacattaccgtccactaccgcataaggcataccgtaagcaaacgaacagatcgctgccgctgtatactcccccactcctttcagagccagcacttccggatacgtttccgggaaaaccccattcatgcttttggcggcggcatgaagattgcgggcacgtgagtaataccccagtccttgccagtatttcatcacttcatcctcctccgcagcggctaaagtccgcacatcgggaaaacgtttgataaaacgaagaaaataatcatacccctgcgccacccgcgtctgttgaagaatgatctccgaaatccagatcagatacggatcggcagactccctccagggcagttcacgtttattctctttataccactctacaatcgttttagtaaactcgttcatatcctcgttcctagtgtattatctaacatttatcttgcctatcctatccaaaaggcacacaaaagtaactcttttggttctaagaaaaccctatgccactatttttttagaaaaatgtgcagaatatatttttttaggagcttaaaaagctatatatttgcagtccaaaaaattagcaataacatagtaataatattttttttaaggaaaaatgactaaagcagatattgtaaacgagattacaaagaaaactggaattgataagcagacagttcttacaacagttgaggcatttatggatgcagtaaaggattcattgtctaacgatgagaacgtatacttgcgtgggtttggtagtttcgtagtaaagaaaagagcacaaaagactgctcgtaacatttctaaaaatactacgatcattattccggagcacaacattccggctttcaaaccggctaagacatttacaatttcagtaaagaaataataaacaagagtattaacccataaaatgtgaagctatgccaagcggaaaaaagaaaaaaagacataaaatgtctacgcacaagcgtaaaaaaagactaagaaagaacagacataaaagcaaaaaataatttttaagtctggatcacacagaaataaagaacaaacttgcgaagctaatgtctttcaagtttgttctttgtttaagtagctaacccaaaatgaacaatttgtcaaaaaagttgttcatataaatgagattcaatcaataataaggaaacaaaacagtgacaagtgaactagtagttgacgtacagcccaaagaggtctccatcgcccttctcgaagataagagcctggtggaacttcaaagcgaaggaagaaatatttctttctctgtgggcaatatgtatttgggacgtatcaagaaattgatgcccggactgaatgcatgctttgtagacgttggttacgagaaagacgctttccttcattatctggacttgggtcctcaatttaactcactcgaaaagtttgtaaagcagactttaagcgacaaaaagaagctgacctccatcagcaaagcaaccctgcttcccgatcttgacaaggatggaacagtatccaacaccctcaaggtaggacaagaagtagtggtgcaaatcgttaaggaaccgatctccactaagggaccgcgactgacgtccgaaatttcgtttgccggacgctatctcgtactgatcccttttaatgacaaggtttctgtttcacaaaaaattaaatcgagcgaagaacgcgcccgcctgaaacaattgctgatgagcatcaagccgaaaaacttcggtgtcatcgtccgcacggtagccgaaggcaaacgcgtagccgaactcgacggagagcttaaagtcctggttaagcattgggaagatgcgatggtaaaagtacaaaaagccaccaagtatccgacgttgatttatgaagaaaccagccgcgccgtaggtttgttgcgcgacctcttcaacccttcttttgagaatattcacgtcaacgacgaggctgtgtacaatgaaattaaagactatgtatcactgattgcgcccgaccgggctaatatcgtgaaactgtacaaaggtcaacttcccatttacgacaatttcggtatcaccaagcagattaaatcatcgtttggtaaaacaatctcttacaagagtggtgcctatctgattattgagcacactgaggcgcttcacgtagtagacgtgaacagcggtaaccgcaccaagaatgccaacgggcaggaaggtaacgcactcgaagtaaacctgggagccgccgacgagctggcccgccaattgcgattaagagatatgggtggtatcattgtcgtggacttcatcgatatgaatgaagccgaaaaccgtcagaagctttatgaacgaatgtgtgccaatatgcagaaagacagggcacggcataatattctgccgcttagcaaattcgggctaatgcagattacacgccaacgtgtgcgtccggcaatggacgtcaacacgaccgaaacctgccccacttgcttcggcaaaggcactatcaagtcgtccattctttttacggacactttggagagtaaaattgattacctggtcaataaactgaaggttaagaaattctcgttacacgtccatccgtatgttgccgcttatatcaatcagggactcgtttccctgaaacggaagtggcaaatgaaatacggattcggtatcaagattattccaagtcaaaaactcgcatttctgcaatatgtgttctatgatacacatggagaggaaatcgatatgaaggaagaaatcgaaatcaaataaacagaaaaggcggcccggtcaaaacgagccgcctttttgttttatctatttttcttcaactatccatttttcaatattacgggtttccgcactgaaatttactcctattttaaagagtttccgttcatccatctcgaaaggaagagcgtaatgcttgtcatttatctgctgcaatgcttcttctgccgtaccgttcagtttaaattccatgatatagatgaatttgtctgtctgcaagacaaggtcgatgcgtccttcgcttgtatgatattccactttggcatagaagccgaccagtttaaaaacgatgaaaagcacgttctcgtaatgcaattcctgatcgcgaatcacttcgtaggtggtatctgcaaagaagctttgcaagcgacggaagaaagaactgtaatcgccggaacgtacttcacgaacaaatttctgaatttcaaacggagattctaccttatttacattcgcataataaggaagcaggaaacggacaaatccttcttctacttcacgattcgggaaacctaaccgatacattccaaattcttcatcataccctttaatggtgaggtagccactctgataaatcaccggaatgggattagtagattcagagtctatgctattcaatacttgggcgtcggtttcttcatgcgtcatccgctccaagtcataatgatgtttttgcagcaatttcaccagataggtcggtgtgcccgtttcaaaccaatagctgccgaaatccttacgtttgaaagcattaagcaaactgaacggattgtacataccaatagaattgtgcgtaaaatggtaaccgtcatagcactctctcaactcttcacaaagtttatcatacgttattccgcgcgcagcagcaaattcatgaagctctgtttccaaattgttgtggatttcacgctcgctaatgccacagatttcgacatactcattccacatggatatatcatccaagttgttcaagtcactaaacacactgactttgccaaactttgtcacaccggtaaggaatgcaaacttgatgcaaccgtccattgttttaagcgctccataaaaaggctttaatgtattccgaaattgcttttgcaattcttcattaccgatggcttgcaacatgggtttgtcatattcatcgacaagaataaccacacgttgccccgccaacttacaagcgcgctctatgataccggcaaaacgcaaggaaaacgaacgttcggacggctcggcaccatatagtttttcccatgctgtcagcgatttatcaagtatattatccagactttcggatgtatcatatttctcgatattaagatccagatgcagtataggatatttgatccagtccttttccagtttttccacagccagcccttcaaacagttctttctttccttgaaaataggcctctaaggtggagaggagcagactctttccgaaacggcgcggacgactcaagaagtaataacttccggtctttaccatttgatacatcagtgctgtcttatcaatatagaaataaccgtcattacgaattttttcgaaattctgaataccgatcggataaattttatggctcatattctcttcttttattaatcaatgcctttcttgcaaagatatatatttttaatagaaatctttgtcatggcaggttaaaagattcttttcaatcattcattctgcacatttccccggaaacttagggacgataaaataaggggataatgactgcacaaaattacgaaaagcccggactttcgcaagctcgggctttctgtatcttgaggacgtctcctttacctatagggaaatgggcgactagcaattgattctagtacaacaaaaaaagacgtcccaagagtaaagataaaagggatgccagtaggaaatgtggggaggcatcccttttctaatagaagaacaaagatggaaggatggactttcacaagctgtgtctcttcgctttgtcacttctcaacatataatcttcacacttcggtgaagaagggtttcatatttatggagagaacgcacttcaacaagcacgggctctcctattatgttatatcattctagagatagctcccacctctgccagaggcaaatatagaggagctatctaatagaacattaaaggatttcaaattaatccgcaaagagagcagtagggaatgttactgtcttcaccacaggtgcaggagatgttgcgctccagctgattgaaggagtaatagtaactgtcactaccaaatctttcacaagacccttcaaggccttaccagcatctgttaatatcaatttctgtccagtagaaaacctgaagttagttttgtcacttagttctaccttaatagaatatccataaagagcaagaacagcgtcagcggtagtcaaagtaccagtgtcataagtgttattatctgcagtcggccacattgccttgccttttctgtctttccatacaatgtcacctaatacatcaatctctgaatctatggttttagctgtatacgctgttgtgataccttttttagcgtccgttgcaccaaattccgatttaagcaattctgataatgagatgaattgaatcttttggttagcaattgaagcaggttcagtagcatcgttaggctgacaatttacatctacagagaatgccatattgtctttagcgtgagccatgtctactgtgaacttatcgttagctacacttcctacatgatcgtcaccattcttgtcaacatcatacgtaatgctgttgtatatacctgaagtaactccgccagtaatagcgttccatgtagtaaagattgagcccatttctctttcgagactgatgctctgaatcttatcagcattcttagtttcattaatcagaagagacaccttgccatcttcagtccacatacctgaagtttttgtaaatacaggcgtcttataatcaacagttaccggtaatttgaatacaatttgcttcgttgcgtcaacgtcaactgtcaatacggcttccatagtacccttgtatgcagcggttactgtcagtttcaggttatcatatttagtatcaccagaagcaataccactaaacttcactttatctccatcgttagccgtggcagttgagctagcaagtttagcagtagtaatagcgtctttgattgccttaatattagctgctgacacagcaatgtcggatttttctgatttattccaaactaccgtctgtgctgccaaagattttgtttctatttgcttgaaggtgacagtcagtttagccggagcagaggagccaccgacgctagaataatcaatgccctcatgagtttctccatcaaaaggaataccatttgtagttatatagcagacttcaacctttgcttcttgccctttggtagaagtgatggtttgtttgccggcttcgttcgtccccaatgttacaccttcaggagcatcggctgccaacttataataatatgcatagactgtactcaaatccataggagtggtggtagctgcagctgccaagtcatccaaaacctgtacctcaccaacttttgcggacactgctgcatctaccagtttagtagcacttgtaactgcttccggtttgattttaacatcataagcagagattatttcattgttccatgcgtcttttgtacagaatgcgtatgcttcatctgcaggaagggcagtttccaaattcaagccatcttttagtgtaacagtaaggtcgtaaacaccacgattcactttggcttcggtagcacgtgtcaatggttttgcagttttattttgttcaatcttagagataacaaaattagcttcattttgagaattcatcaaatagatttgatatttgctatcagtaaagtcaggacctactggattaatcaacgcattcaacacgccggaattagttattaacaggtcatttttcttaaattcttttttctcatcctccataccaaaagtgaaatcagctttgcattgagcataacttaatttaagttcctttgttccgcctgcagtgattttaccattctcaatagtcactccttcaaggctactaatcaaagctgcagtaggcagaatagttgttaattctgttccagtagttttatcttttacatgtagagtaaagctaggtaatccctcattctgtacagcataaacagtggctgacgaataatcacctttcacccatttatctgtagcgtcatcatagaaataccaataatctttttcaaattcacctgttccatcaccaataaaaggagattttccggcaggaccagcaggaccttcgggaccaacaggaccgataggaccttcggggccaacaggaccgacaggaccttcgggaccaacaggaccaacagaaccttcggggccaacaggaccaacaggaccttcggggccaacaggaccgacaggaccagtagcaccggtctcacccttttcacctcgtgccggtttcccagtatcaacaccgtctataaaccagtttccattttctccaatttcaacgacagatccatctttaccattcacaatagaatatttatttccattgttgaaagtaatttcaaatccaccagtgatacttttaatgtctgttacccaattacctgcattcacttttgcttgcagttcagcaagacctgccgcattggcatcaatctgcgtttgcagattgtcgatgtcatcatcatagtctttacagcctacataagtgacagtagcaagcgtcaatgccccgaaaagcattaccctaacaaaatttttcttcataactacttaaaaattacattaataatatattattaaacactaagtttcaataatagaccgcccgttactttgtaggtaacggagaaacctttgttcctgctcttttggagtagtcaatacggaaaaatgaaacaatatgcgattacatttttacccctgcttcttagaagcggcagaggggcgggagaccttttgcaaaatttagaagttaacaaagccctaatacaaagaatccgcgtgttttatttgtttaattcctgttttgagtagtttattagaaaaaatgtatgatttcgtttggttgttttaagaaatatgctcatatttgcaccgatatttcaacccgttacctacaaagtaacagaataaaaatcaagcacttacgccgaccacagatcgttttataaaatcaagtacctgcatatttgcttcatcaattttcttatttcggaaaggcttcaaataagtttctgtcacggtgatggacgaatgtcccatcgcttcggaaataatacccggatgaatttcgcaataatacgcagtcgtagcccaggtatggcgggcggtgtacgagctcaaccggtctttgagtcccaatgcctttcctaataattccaactgataattaaaattgcgcaatgccagttgatattccctatacgcctttggcgaaccttcgtcactatgaagaatcgggaacaaataaggcgactgttcctcccgattcatatacttttgcaaaagaaacatcgcttccgtcgtcaacgtcacagacaacggacgtcccgttttacgacgacgataactaatcacatttccccggagatcactcttgcgcaaataagccaagtcgacaaaaggcagtccccgaagcaagaacataagaatgaacaactcctgcgcccccttcatggcaggagtgatggcgtccgactgcaacagacgggcaaataccttcttcatatcctccatatccaatgcccgacggcggtctgcccgcgtacctgtatatacggagcgaaaaagatgcggcacgtatgatgccttccgaagatcgacagcgcgattgtaaaccgcacgcaacgtgcgaagatacgtagacaccgtattccaactacacccacgtgcacgaagactaccctcaaaatgcttcagccactccggagtgatttcccgaaacgacaaacgatcggaaccctgaaaagtaagaatcgcattcaacgtacttctgtatacatgagcagtccctaaatttccactctgctgcaaatcaacagccacttgtttcataaacaaagtaaaactttcctttttcattaaaaataaattaataattaatatttacttttcccacattttactttagtaaaatacaaaaatatatcttcaaaaatttacatacataaaatctaaaaaataaaaactaaaacatttacattaatcatcaaagtaaatttcatacatttgcgcaatttttcaaacaacatattattttaaccatttaaagtataaaaaaattatgaacaacaatgaaccagctgccgaacgctacagcattaatggattcaagtatttctccgaattggcgaaggagtattttcccgatctggcaaacgcttcttccgccagcaaaaaaatgcgcaaacgcattaaagcaaacaagacattgaacgaacaactggttgctgcgtattacaccagccaaacaatcgatgtcagtcctgaaatgcagctaatcatctaccgacactggggacctccccacattgacttgccgacaaacgtttagcgcgtaacagaaaacgaaaacacggacaagaaataaaaggaaaatcgaactatatatttttaaatatatcatttatcttttattgtttattatgtattccactttgcgttcatcacttttttcaaaacgaagataactaccaatcatacagctatttacagaaagaaaaaagcgttccacaaagcgttaggcaaaaatgaccgttttttcactacaaacaagaccttcgaatccccccaaacgaaggctttgttttttctccaacagaagctccaccagtcacaaacagaagctccaccaaccaccaacagaagctccgccaaccaccaacagagcattcgttccatccccactccttccccggcttcatgaaagaagaaaaaaacagccatttgcgcatcgcggcaccctttattcatccacacccgtccgcacggaaccacaccccttgcgcatcgcacaagaacggcgtacctttacagaaatttaaaacgataacccaatgaacaatttcaattttgaagccatgatggaacatggttttctcattatccccaaagccctgctacaacaacagatagaagacccgaacatagaagccggagaaatagaagcgctcctgaaaatcctgatgaaagtaaactattcggacacgttatacagcgaccggcagcacaaagactacctgtgcaaaagaggcgaaagcatgttcagctaccgcgactggagccgcattttccgctggtctgtcggaaaaaccttccgattcatacacgcccttgccatcctggggatcatcgaaatcgtcccccatcccaacaactcgtccctgcatatccgtgtcgtcgaatacgacaaatgggtaggagcccccgacagcggcaagcagaaaaagaaagccgtcaacgagaagttccgcctgttttggaatgagtttcacagcatcacgcagcttcccaaagaaaacatcgccaaagcgcaacgcgaatggaaaaaattaagcgacaaggaacagcaactcgccatcgacaaggtagaagattattatttccaccaaacaaacatcaactacctgctccacgccgccagctatttatccaacaaagctttcctaaacgaatactgataaaacgaatcccaattaaacgaagactgattaaacaaacactgattatgaataccgaaaacagagtttcaccacaggctcccgaaatagaagaagccatcatcggcgcctgcctgatagagcagagggctataccactgatagccgacaagctgcgccccgaaatgttctacgtcctgcgccaccaactgatctacgccgccatactggctatgtaccacgccggaatgaaaatagacatcctcaccgtaaaagaagagctttcccaccgcggaaagctcgaagaggcgggcggagcgttcggcatcacccagttgagcagcaaagtggcgacttccgcccacctcgaatatcacgcgcagatcgtacacgagaaatatctacgacgcgaaatgaccttgggattcaacaaactactcgcctgctcgctagacgaaacgatggacatcgacgactcgttgatggacgcgcacaacctgctcgaccgtctggaaggcgaattcggccacaacaaccacatgcgggacatggatgaactgatgaccgccaccatgaccgaagccgaaggacgtattgccaacaacataaacggagtgaccggcatccctaccggactggcagacctggaccgcatgacgtccggactccaaaacggcgaactagtggtaatcgccgcccgtcccggcgtaggaaaaacggcattcgcactacatctggcacgaaacgcagccatggcaggacatgccgtagccgtctacagcctcgaaatgcaaggagaaagactggccgaccgatggctgacagcagccagcgaagtcagtgcccgccattggcggtcgggaaccgtcagcccgcaagagcttgcagaggcacgcacggcagccgccgacctcaaacgtctgccgatacacgtagacgacagcacctcggtcaacatggaacacgtacgatccagcgcgcgactgctgcaaagccaacatgcgtgcgacgcgatcattatagactacctgcaactctgcgacatgacaaccggccaaaacaaccgcaaccgcgaacaggaagtggcacaagccacccgcaaagcgaagttgctggccaaagagctaaacgtaccggtggtactgcttagccagctaaaccgcgaatcggaaaaccgccccgcaggccgccccgaactggcacatctccgcgaaagtggcgcaatcgagcaggatgcggacgtcgtgatattactctaccgccccgccctcgcacgaataacaaccgaccgcgaaagcggttaccctaccgaagaactaggcatagcaatcatagccaaacaacgcaacggagagacgggaaacgtatacttcaggcataattcggcaatgacaaaaatcaccgaatacgtcccaccgctggaatacatgctgaaacatgctaaatagatacagattcaccccgattccatacaattttatattacaatatatagctgtatggaatttctttttttatttcattattgatataaaataaatagcaaaatacttgactttccctttcaaatttcgtatatttgtaatgtcaacaaggacagaaaatattattacttaaaccttaacttttttaattgtatgaatgtattagtggagcgctatcagcgcagaaagtatgtgaatcagccggattcacagatgttgtattatgtacgccagaaatcgggtacagtgagagtgatggacatcaacaagctggccgatgccatcgaagcgaactcatcgcttacagcaggagatgtgaagcattccatcgaggcttttgttgatcagttgcgcctgtcgcttacccagggcgacaaggtgaagatcgacggattgggcacgttccatatcacgttgagcagcgaaggggcggaaaaggagaaggattgcacggtgcgcaatatccgcagagtaaatgttcgttttgtggcagacaaggcacttcagctggtgaatacgagtcatgccactacccgaggcgagaataatgtcgatttcatcctggccggaaagggtgacggagaagacgcggatggtggaaacagcggtagcggtggaagcggagaagctccggacccggcagcttaatcattaaaaacagtgccgcatgggtattacagagtgatttctacagttactctccatgcggtttctgttttcttctacatttattttttaattctcaattttcaatcctcaatttattaaaatgctcgataaaatcatagagatcattatgacgatcctgccctttctgggcagtaatcgcaaaaagcgcaaagtaatggcgcaagaagtaaaagagttcagcgaactggtgaaagaccaatatacttttctgatgcagcaattggaaaaagtgttgaaggattatttcgaccttagctcgaaagtgaaagagatgcatacggagatattctcattaagagatcagctggcacaggctgctgccttacaatgtattaataaggaatgtgcacaacgtagtgcagcagaggcatgataatgattcaattaatgcaaattatggaacctgtgcaatttacagaacctattcaatctatttaatccattcatgagaactataaacctgatagtaatccattgctccactacgcgcgaagacaagagtttcacagaatatgacctggacgtctgtcatcgcagacgaggattcaacggaacgggttatcatttctatatccgcaagaacggggatataaaatctacccgtccgatagaacgaattggtgcgcacagccgcggtttcaacaaagaaagtataggtatctgctatgagggcggactcgattgcaaaggacaaccgaaagatacccgtaccgaatggcagaaacattcgctccgggtattgattctcgctttattgaaagattatccgaattgccggatctgcggacatcgggatctaagtcccgacctgaacggaaacggcgaaatagaaccggaagaatggatcaaggcctgtccctgttttaatgctgaaacggattgggataaagtctaaaaaaaaaatagctttattataatttaggcacggataacacggatttcacggttgctttgtacaagcatagcactaaccgtgaaatctatgtaatccgtgcctaatctttaacttatgattttgctagactacgcgttatcaaaggttgtttcaaaccgacgcaatatgctgtctaattttccaacgaggtaaaaaggtagatttatcaatttgaattcttttccgtctgccgtctttacctcatccacagcataaggctgcgaccatattctgactgcaacagtctgattagagtgattcataaaagaatgtaaggaacgcaagtgggcgttatgccctgatttgacttcaatgggataaaccatagaatcctgcacccacacataatcgacttctgcattagaaccacttttattacgcacccagaaacaacgtttctgactgactttatctgtcagtgtcaacagttcttgcgctacaatctgctccgctatcataccacgccaagcatccattatatcttttgctcccaaaacctctttctgtacttgtgccgcataattcaccaatcctgtatctaaccagaccagtttgggcatacgctttatttcaggagtggccggaacttccgttgccgtagtcggataaactaattccagcaacatcgccttttccaataaacgaaaagcctctcccacttcccgagcattataagacgaaccagcaaatcctcctaaagttataatttgtccagctttatgccatccttcttttaatataaagcgaatcacttccggaagttgttttcccaaagcatatttttccacatcatcccggtagccttgcaaaagagtttcataagtggactccaaggataaaatatccctgcgctccgcatagagttgcacaacttccggcatacctccaatcaacgtatagatattaaacaataacatcaaacgatcatggaaagcgagagtgatttcaggcttatctaaaacggataataaaggttcttctccaacagcacccagaaactcgcgaaatgaacaaggacgcaatgccatatattgcacccttcccaccggaaatgaaacacgtacatctatcaggttttctaataatgaaccggcagcaattacataaatatcaggtaattcttcatagaaatagcgtaataacgctactgcctttgctgaattttgaatttcatcaataaaaagtaatatagttccttcattccttatctttccacaatgtgcaaaaaataaaggcatcaaatcttttagagatacattcaactcaaacaaggatgctgcctcccgtttctccaaattcaaatacaggtaattgtcaaactgctttccaaattcgttgactaccgttgttttaccgacttgccttgctccacgcaatatcaaaggctttctatgcgtatcgtctttccatctttccagatgaaataagatatctcttttaaacataaaccacaaatttattgattttcagcaacaaagttataaagaatttccaaagatggggcaaaataccattgattttgtttcaaagatggggaaaaagtctatcgttcatgtttcaaaaatggggcaaagccacctaatactgtcgtaaatatggggcaaaaagaacgtatttacaatcagctaatctacaaattagacgacttaccatgtactaactccaatcgtacatcgtaaatcgtctaatcgtaaatgaacttaatcgtaaattatttttctacttcacgtcgaatgcagcatcaatcaacgctttcaagttcagataatgacttctgtatattccactggaagcatttgccgcattggtcaggtctcttctaagatcagtcaactgtccgcgtgcaatagtcggtgcttcagaagggaaatcgaaagctacgagcgaataaccacccagacttccgagcgaaccggaactgttcttcggtttatcaagcattccaatcaacgcattgacataagtcttttgcaaactacgttgggaagcatccggtttctttcctccttgcatatcgctccagatactcttcttcaaatcacggaacaaatcgttggctgtgtatgccttcgctccgttgaccagttcgttgtccgtcatcttatcaagtgtgcggctgctaagcagttgtttcaatgtactgctctgtacacggtagatcgaattgaaagtattgataccagttctttcggacagtttatcatccatcagccaggtcggtgtggtaaacagttccttgttcaggaagtcgaccgctttcttctgaatatccttcggaacatattccaccgctttcatgtctgtctgttccacagaaatcggattgtggtagataccggccacattggtagccacatggcccatgtacaagtcgaattgtcccaccacattctgatacaaacggacagctttcatataaccctcattcggttcataagtccagttcatgatttcaggcatcacacgtttcaggtttttgattccatacgagcttgccagcatggcatcatctcccaaatcttcactctggttgcggggatcgtttctgtcgagttccgttccgaacgtatagcgtttgtcctcccgcagcttctcaatgatccacttattcaagtgaggtatttcggcttccgccgtttcatattcaggcatccaacgatagccccattcaatcgcccatttatcatacataccgatacgggggaatattcccgaacgtgaaacgttgtcttccggctgtgccacatagttgaagcgtgcatagtccatgatagacggtgtatgaccgttggcttccacccatattttgtctctaagtttctctaccgggacggtattggaagaaccgaagttatgacgcagtcctaatgtatgtcccacctcgtgggaagatacaaaacgtaccagttcgcccatcagttcatcgtcgaacatcggtttgcgtgctcccggatcaatggctcctgcctgcacgatgtaccagttgtaaagcaggctcatcacattgtgataccagttgatatgcgtttcaagaatttcaccgctgcgagggtcgtgcacgtgaggtccgcttgcattcggaatatcggaaggcttgtacacgatagccgaatggcgggcgtcttccaagctccaggtaggatcgtccgtcggtgcttctttgccgaagattgcatttttgaatcctgctttctcaaaagcggcttgccagtcgttcactccctgaataaggtacggaacccatttcttcggagtggcagggtcgatataaatgataatcggtttctttggttccaccaattcgccacgcaggtatttctcgcggtcttcgtctttgggttcgagacgccagcgggtgatattcgctttatacttcactccttgcggattctcgtcaaaatccttatagctcacagcaaagtaacctacccggtcgtcgtgcaatctcggtttcatcggttccttgggaagtaatagcatagagctgttcagttcgtaagtcaacggagtggtagaggtggcaaagaaagctgccagcagtttctcaagtccactgcctcctcctttcttccgctggaaggtacgcacggtacgtatttcgatgttttgcggaaaggctttcagtgtgtcgatataactggcgtcgtctaccatgctgctcgctccgatgttgtctttcacccggctggtgaatgaaaacatttcgttgtccttacggatatagtcggtcatgtcgatcacatagttggtagtttctccttctttacggacagttttcagcgggaaggtggccacaatgggttgaacattggagttcaatacggcctgatacatacccagtgtatcagcagaatgttcgagataagagatttcacgcacgaacagtttgtcgccgcgtcctttctcgaaacggatcacttcgtcgctgatgtaatctcccggatagcctactttacgtttctgcgcgtctaccggtgctttcacaactctgttcacaatcaaaatatcacgtccgaaaagagagtcggctatttcgaagaaatatttaccatctacgtaatgcactttaaaaaagccgtccattgttttggctttgccggtgattacttttgcgtaaggttgcagagcatctttcttactcttggcaatggagtcagccttggctttatccaccgcttccgtcttgctcttctttttcttctttttcttgaagatgtccgtcgattgtgctccggccaatggaacgatcattgccagaatcatcagaattgaaactaatttcttcatgctttcttttttaatatttatatacagatacaaagataataattattcgataccggcaatgccatacatatttaagttgttgatactagacatcttttcattcggtttgcctgaaatagtatattcctgtccatcaattgtcaaagtaaaattataggtataagttagccctgtttcaaaaggtacggcaatcatcatataacaggtctccaaactggcaccaaaatacccggcagttatctcgaagccgccattaggaagattataagtaatactgtttatcggagtaccggaaattttacctgtcgacaaatctacagttgctccatcttcgtaggcaatcggatggtcacagctcaccaccactttagtaaatttcttaccgacaaaagaatccgggcatcccgcacccggtaaagtgatttgagaaaacaatggtttgaattctcccaaagaaacagttgcagcagaatagctagatgtagtagccgaagcataagcaaagctataattacgatgcggcataaactctgattcataatactcctgcacagctaagttgggcaaagcgacagccttataatcttgtgaagctgcgttatagggcgtataggcataaatagtgtgatcgccacccttaaatcctgcagcaagttcggaagaaggattcagcgtaatatcttcagtcacacgactatcacgatcatatactatatacgttttaccatccaattctgtagtagtagccaccgctacttccgacggagcatacggcaagttatcctgcggtttgccatcggacaacacatatattcctatcttgtccgcttcaatccatccctggcttccatgggaatacacattataagcaccggaaacagcaattttccccactacgggaatatctgcatcttcttcttcaccatcgtcactgctgcaacttactgaagacaatactaaagctacacaagcagcaaaataaaacagtctatttttcatacttttctcgtttaaatgattaattatttactgataggttattttctttttccaattaatattctccttcatagttcgtgcaccataccatgcctttcacatcgccaaacccgctaaaagtcttcaattccaaatcgggagcaaaaccttcgaagagacgtaccatctggctcgtgtttacatcgatgatggcgatatccccattttcctgcgaaagtgccagccggaaattcggatcagtgctatttcccccatagccataaaactcacaaacaacaggacttccactgatgccggtgatacggctgcctgctgtgtaagccagcatatggctgcgcatctgcatactgtatatatagagattcttatctccatcggtaaagtagaaataaggggtcttttcaaaattggaggacatcttaatgacactttgcggagtcaataaggagctgccgctgaatccgtattgatccgtaccggttatcaggtgagagttattatccatgtcttttacggcaaactcgtgcaaatcataatttccggttccctgcacgtcaatcagcgacacgtagtttgaccaaaatgtcagcccgccgttggaggctacatctttcttttcgtaagcccctattgccaggcagcgggttcccgctcccatattgttcacccgcaacacaccggagggaacttccaaatcctgatcgtatgttttgaagtagacgatggcaggagtataaactgctccccactgcggataatgtgtaatgccgataaaacgggcattttgctcatcatacaagatacaacgttcttcgtcggcacaccaataagtgacgttgtggaacggtgcgaaacaggtgatacggctacctccctcaaactcatacggcatggcgccgtacttcccgtaataaggaatcgctttattgtcagtgcctacggcacggatatacacttccccctgttcggagcaaatcacgtaatattcttccttgaatgcgaagtccattatcttcaagccttccggctctttacggttttcaaattcgtgggcaagccacatgtctttttgcaacgaattgccatctagcgtgacacttccactaccctgatttatcaggattttcggcaaacctgacacgtaggaaccggagatagagcctaatacataatagtaatagatcccgagcgggtctgtacccagaccatcttcgatgatgttttctacatcgtgcgtagcccggaggccgggattgatgaaagataaagaagattttccgtctcctttgttggagagaatcatccagccccagtcgaaactgttctttcccgtcaaggtatatttattgctgatgtatgtttcattcgtttccttattgatgactttcagtatcagttcgtacgttccgcctttttcgaactgatacttcagatgataacctgtgtagatcagttcacggttcagataccattgaacggtgaaaagttcatcaacattcccgatgtccgttgagaagttgatgggcgcatccatctcgaaaaggtcgcctaccataaacgtgtagtccgatgaagcggagttcacaaaagaaactttggtagagtttgtatagtcatagtttcccaaatcgtcataacagccggttatcatgagaagctgcaggattgaaatgaatagtattgtttttcgcttcataatttattatcagttatcgagaatggtttcatacagcggtgtcactccgtctgtatcataatattggtaattgccttgctgccactggtctttccaccaggccttgaagtcggctatcaggttgacaaactcaataccggtgtatttatccaatgattcgagtatctcaccatccatgaaaatgataaaaacacggtatttcatatccgaataagtacccagattggctgccgaactctggttccaccaaacaggttgggaaatccggtcggtcacttgaatcgtgacgtgtttgtattctgccggacccaccagacagttttccactgcatccagtgaaagggtaagggtgtagtctgtgttgagcaggtcttcattgcgatagacggtgacttcgtaggtgtcttccgccagtccgctatggaagatgccggaggtcaaaggggcatagtcgatgccggaacgggcggtgcttttctctcccactgcggaaatatcacaggtggcattttcttcgagcaggtagccaagaagtgtcattttcactttcacggttccttctcgaagcaagggtgcatctgtagcaaagttgaatgttattttctgtggagacttatcgctcatgtaagtaaaatagacgtaattgtctccattataaacgtccagctgctcttcactgcaagaggtgagaacgaacagcaggcagaagatggtatatgtcaatattcgtttcatcttatccgggcattagttggttgtttcactggtaggcaatggaagtacataagaacctgtcatgttgatttctccttcctcgtcggaatcgggcacggtggagaggttcatccgtttgtaggtgtagaaggttccaccttcgcctatcatttctttccgtatatcgagcagtatttcggcatccagttgttcacgggtgctgactgtcagactaagggtacgttcagctccacgggcttttcgaactgtttcgaggtagttgattccttcggttatcttgccattatagctactgatctccgccaggatatgacagatttcactgaaccggatcactggtatcatcggattctccattgcttctactactgattctacggaagggttatacttcagtgtgtaatacttcgactgggtttcattggtagtcccgatcaggtaggtgagccgatagtcggtatatacgcccgtattgtccgaagcaaacagggaagggatatttgccaacggcaaacgggtggttgacgaagaagaggaagagccccatacggcctgttcataatccgtagccagctgtttcttgtacaagccgaacaatatgtcgtgggagacttttgtatatcgggaattgagattgcaggtaatgttctctccttctgtaaagcctatccaccgtttctgctggtaataggtgttgtaaagttctttggcggctgtctcggcattcttgtagtaggcaggaccggcatagatgcagacacgggctttcaaccccagcaatgccagatagttgaagcggatgccacgataccagaagaatgctcccatatcgtctatataggaaccggagttgaagcggtagcgggcattccattcgggagtaggttcgtacatttgtgaagcgtacatcgcttcgggatggtattcggtgtcaaacttacgcagaatgtcttccgcttcgagcaggtctttcaggactttctcgataaaatcggtaacggtacatttttctaccactgcggcttcgtatttatcgcggtaaggaagataggcgcccgaaggattggttgccgttgcaggagcaaacaagcgaagtaggtcaaaatgcatcatggctcttaatgacaaggcttcggcgtaaatgaggtttttctcttcttctccgtattcgaacaaagagatgtccgtgggccggatgttctcgatgagcttgttcaggttggctatcactttatagcctttttcccagatagctgtcacgacgggttcggtgtcgaccgtgttatagataagttcggaagcgtcggcatacatcggagagatggttcccgccttttgattgtattgctgggagatggcactaaggaatccccagcttagttgcttaccgtaaagttcgtcggacgccagattggtgtagataccattcagggcattccggtagccgaaaccggtggaaaacagatcgtcgtcggctatcgcattttctggtgttacgtccagccaggcattgcaggaaacggctaacattcctgtcagggctattagtatatggctgattagtttcttcatttgtatggttagaatatgatgttagtagtcagattgaatgaacgcgaataaggataatccagtccccgttcctgacggatggtagaccaatagaacaggtcgttcatcgtgaacgaaagacgcaggccggacagatggagtttctttaattgttcgggacggaaattgtagctcattgtcaatgaactccattgcagggtattgtttttctgtacaaaacgcgaagatgcgccggtggtgacattacggtcacgaatatctttcatggtggttatgtctcccggtttctgccaacggtcgagcaatacccgcttatctacattgtcatttttaatgtcggcattctctacataggagacgagggtattgttgtaagcatctccaccaaaagtatagaggaaagaagcaaacatggataactgtttataggacagggtataaccgaatgagccttgtcccttgggagctgtatcgccaataatggtccattcgtcggcagaccatacatcggtaacgtcaccattccggcgaaggtagatttctttgccgtttgtggggctgattcccaatgacttcatcccgtaaatagaggtcagagaggctccttcgtaatatttcaggtatgttttagcatattttgaatcggagctgctttcggggttatatccgctgaacagttcttccactcttttattatagtcgcgcattgcctgggagatttcaataatcgtgtttttgtttcttgcaaagctgccgtagagctggaagagccagtttctgtcactgtaaagtcgtgcccgcagttccagttcgacgccggtgtttttcacctttcccatgttttctttgtaggaggtgaatccggtagaggaagggatggtataatcggttatcaggtcgatggtacgctcgtcgtaggcagaggctttcagatagattttatcgtgccacagtccgatttcaactccatagtcgagggtgtatttacgttcccatttcaggttcggatttcccatctgatagaggaatacaccgtagcctgtgggataccagctgtctgtttgcagctgatacatatctttggccgaatagagggagaagttggtctttccggtcagtccgtaggagacacggaacttcaacatggaaaagagttcattcgacttcataaaatcataattatgaatgttgattcctgctcctgttgaccagaacatggaccatcttttatcggaaccgaattcggaagaaccgtcgatacgtcctgtaaggtcggcgagatagatattgttataggtgtagttggaagtaagcaaggctcctaccaagcgggtggtattgtcggagctgctgggctttccgtatacttctgccgcatagtttgaagagacaaggtcgccaccagggaatccccggtaacgtgtttcggaagcagtgctctgcgtttgtctcatgttggaggacaagcagatattgagattgtgtcccttgaaggtattgttgtacatgagtgacaggcttccgtctatcactgttctcttttgtgtggattctgttttttcaccattgatgttgcctgtactggctgaataactggccgatgcgggatctttgtacagatcaccggtagaatttctcatcaggacggaaaactgaccgcgcagacgcagaccgtcggtgatacgccaattcagactaagatcatcggttacttcatcataaccggaatggtcgaagctgttgtagaagttgatttcgtacagtggatttacttgtgtgccgctagccccgtcgaacttttcgagacggcgcacataatcgccattttcatcatacagacgcatataaggaagtaaatgggagtaatcgctgaatgaattgaaggggacatctgtgcttttgttataagtgtaggtcactttgttctttatttgtagtccgccaatgcggtagtctacataaaaagcggcattggcattcttacgggaagagtgtttcatcactccttccgttcctctgaatcccagttccactccccagcgcacgtcgttttctccaccgtctatgaaaacggagtgtttatggttcagagccgtgcgcagtccttgagaaagccaataggtatcgacacctgtcagtacattattgagtcgttggtagtaaccgttggtataggggtctatttccggggtgttgctgtcatatagtcctgccaggcgttcggtttccagcttctcacgggcgttcatcagattgtaggaggataaatccggcagttcggcagaaagtactccggaatactgtacacggaactttccggcttcgggcgcacgccgttcaatgacaattactccgttggccgcacgtgaaccgtacatggcagtggcggcagcatctttcaggatattgatgctgtggatgctattcatatcgaggtcgtatatcttttctacatcgacttcaaagccgtccagtatgaagataggcaggttggaattaccgcttagcacttcccgcgaaatggaggaggtggaggtctgcccaagtgtcgtttctccgataccggtctgaccacgcaagacgaattgaggcaggctgttgggatcggaaccagcagccagattctcctgtattctgaaagagggatcgaaagtctgaatggccgaaatcaggttgttcgggttgacttttaacaggtcttctttctctatctttgtggtatttccagtgaaactttctttctgtatggagttatagccggttacaatcacttcctgaatactttcggtagcttctaccatctgcacatcgactttctgccgggaagtgactttgattttacgggtttcaaaaccgatgtaggaatagataaccagaccgcctttttcgggcagggtcaatacatagcaaccgtttatatcggtaattacaccagtagaatgaccatccaaacgaatcgtcactcctaccatcggttctttagagagtttctcaatcacccggccataaacacaatttccgtgtggaggaagaagatatgtctcttttgaattatttttgttttgggctattgcattagtagatagtgataaaatgtatacaaacaataagattctattcaaagccccggaatttagcttttgcataacggatatatatagttattacacccgcaaaagtattcttatatgatagacggagcaatcacgaattttaggtattttacacaactattataccaaaatataattaaagcaaaatctttttgcttctgtttaggtattaatcaatagcaaaaagaataactgcatcatttatcctctatcaaaaggcaaatgatgcagctgtcggttatatctgtttttttataatgccagacggtatatctctttgctgtcctgtttcgctaatttgacatagttgcctaccaattcacctttattccggtgcagactatctgcaaggcggtcgatgtcgggattctcaatgccaagttctttgaaggtcacaggcaggccgatggaagtaaagaaggatttcagacgggaaattccttcaagggctaccgcctttttatcgtctgattctgccactccccacactcggatggcgtattgggctatcttatccacattgtgttctgtcatccatgtcatccaggcagggaagattacggagagtccggcaccatgagtcacgttatagatggcgctgatttcatgttcgaggaagtgggaagcccagtcctcttcacaacctacaccacaggttccattgtgggcgatcgttccgcaccacatcagattggcacgggctccgtagttttcggggtctttcatgacggtagttgcctctttgatgatggcaagcagggtaccttcgcacaggcgatcgcctatttctacatctttcgtgttggtgaaatagcgttccatgatgtgtgccatcatatcggcaatgccgcaggcggtttggaaaggaggaagtgtgtaggtcagctcggggttcatcacggcaaaaacaggacgtagtacaccgggagcacggaggcttaatttctgtaagccatcgactttcgtgatgacggtgttaccggaaccttcgcttccggcagcaggaatcgttaacacaacggctactttcaatgctttcgtcacaatggcttttccgatgtagaaatcccagaaatctccgttgtaaggaactccggctgcaatggctttcgccgtatcaatcacagagccaccaccaacggcgagcatcatgtctacgttttctttccggcagagatcgattccttcatacactttcgtgtctatcgggttaggctgtacaccacccagcatgcaatagggaatacctacttcctgcaatgatttctcaacacgggccaacaagccgctacgtatcacggaaccgccaccataaacaatcattattttgcgtgcaccgtatttctgtactaacactccggtctgcgcttccgtatcccgaccgaacacgaattcagtagggctgtaaaagataaaattattcattgtcgttttctttataggtcttttcgtcagtcttttctatagatccaaatagaactcctttgacaagtttttctataagttcttttatagagcccttcataagagtctttatagatcagacaaagttataaatttaagcagaatatctttcttttgattgtttaaaatttcctactttcattagtacaagtccgattacaatccagaccatttcgcgtatacgggtaatcaaagcggcatagactccgtaagctccggaaagggaaaggccgcctacggcgagggcaaagccaccttcacgacctcccaattgcataggcaggaaaaacagcagattagcaagtaaagaagagaaagccgcaatcaggcagcagtcggcaaagctgacatgggtggtcagcacgttcagtatcagccatatttcaagacaactgactacacgggcggtatattccagtaagagggcgctataaaaggtttgtttcttttgttggtggagaagggcaatttgtttgtctatattctccaacttctctttatgcgcgtttgcaaaatgaaatactttctttttcagaaaaggaatacgaccacccatacggacaaaagccacagccatcccctgccgatagcctttcataaaaagaataacaatcagcaagcaaaagacagtaatagctcctaagattatccccatcatccaccccaccggatagagacaaacgtaaagcaacactgaacttaaccaaaagcaaaagtgggaaaagatatgcatcatcacataaagaatcacggaagaggtggcgcgttctattcctatatagggtttcagctccataatgcgatatggttcgcctcccatcagcccaacaggagtcacgtaattaagcgcaaaacctgttactgtgaatttgtagagccggacaaatgaaaaccccgtcttaccaccactacggatgatgatgtaccacgatactgtattaataaggtagacaaacagccatagcaacaaaaccaaaggtaaatatacccctgcacgcttcaaattcagccaaagctcctgataatccatatcaaaagtgaatatcattatcagaacggcaatgataccaaaagcgagaaatatattacggtacttgttcttcactatttgtgagacttatatctattttttatatgggtatatatctgcttttatatgagtatatacttgctttttgtatgggtatatatctcactttattcacatataatcttactttatatacgtataatatctttcgaagaatcttttgaacgccgggattctcatcaatatgtattcgaataccagccaaccgattaacgcgcaagagatgccaagtaatacatcaatgatataatgatggcatgaataaatagctgttccccaaatgccgaccatgataatagagaaaagagtaaccacataccacctgcatttaccaataatggcatacaccaatgcaactaccatataggccgcatgcagtgaaggcactgccgcaaaaacattagcattacgcccgtagatagaatcaaagatggttactccgaagaatgcatcaaagcgtcccaatcctgcaacattacccggtgtgtttaatatcggttcgaaaccgtagttgatggcataccaaggcggagcggccggatgaatataataaccggcaaaaccaatcaaattgacaaacaagaatactaacgcaaagcgaaggtaggtttttctttctttcttgaaatacaggcaaagaccgaacaggatgggaacgggaacccaacaaaggtagaagattccggcaaaaacgtccgctatcggccagttgtgtgcagcgaagtattcgcaaggagtaaccagaagaccattatccattactccgaaaagagacttttcgagattatacagtccggccacatcaatcgggttcacttcgtagttggggcaaatacgcatccagtcatacgagattccaaaaatggcgaaaggtaacagggccacagccaacttacgagtaggtaatccggcaaaaaataaaactaaatagagtaccgccattaacaggtgctcggaacgaagcccgatgaagatacttgtcagcaaaaggaaaagagccataatgactgtcacagtcagggcttctctcttcgacggcatttgaatattctttatcattataatgttttgattagacaactagactatttactattagactatttactattggactatttactattggactatttacgatgtactatttaggatgtacgatgtaaatagtaaatcgtccaacagtaaattaattcattctttcatcactttgtagcaatgtctcacacgagcaaatgccgtgatattggcaaacagggcaacaaaagccagaggaacaatcataatcaggattggttcgaaaacggtgatatctttgaaaacgccacagaacaaagctccgagactggtcagcactacgcgttccggacgttgcatgaatccgactttacattcaattcctaagccttcggcacgggcacgcacatagcttaccatcagtgagccgattagtgccacaaatgcaatgagtgcataaaggaaataatctttcattgataaatagtaacagataccaaagaaagtcatcaattcactataacggtcgagtactgaatcgtaaagcgcaccgaacttggaactcatgttgcctaggcgagctacacgtccgtccatcatatcgaacagtccggcaaacaaaatcacacctcctgcccagccgataatggccaaatcgttctgtccgccatatatgccggcatatacaaacatacctgccgctactacattcaggataaatccggtagtggtgataaagttaggagtgattcctattttaatcattccgcgtatcaggggattgataatcttataaatcaactgttgtaaataatctctgtaattcatctgtttaaatctgtttatagctatttttatctaaatcttctgttttctcaatctgtatatatctaattctttcgttttctcatcagtcttttcaatccgtttttcagtttctttttccgaacaaacttcttatatctatattccggtaaacaaaaaagcgttgcatattatagttccagaacagtgccacgatgactgccactaccactttaggaataatgaaaaaatctccgaaatacaggctaagtgtgttgcgtacccagggaatcttcgctaatgattccgtcagtgcatacgttccccacgtattgagccaaacactgcaaacccatacaaggataaattttacagcaacgtgtgttttctttcctttcgatttaaaagtccatttatagttgataacgcaattaacgattcctccatagatagctcccgccagggtggcatatacatagtagacatcaaacagcctgaccagaagaatcgtaacgagaaagtctgcaatagttgccatttgagcagaaagctgcgccctcaaaaacatgaagatgccgcctttctgggaaatcatccgtgcaacttttttcagccaatcacccatctcgctcccactaacaatataaaactatacactcccgccaaaacatcgtccatcatgacccctaccccacctttcaggctttccatacgacgtatgcccaacggtttggctatatcaaagatgcggaacaaggcaaaagccgcaatcacgtaccaaaaccatttgtcatcattgggaacagccaacaacggtatccacactcccaccatctcatccactaccacacgcgaaggatcttctccccaataagtctccagcttatcggcagcccaaatgccggcgaatgtaaatacaatcaccaaagcggcagtcagccataatacccaagagaaaggaaagagaaaataaagtgcaatccaaatgatagaagccagtaacgccccagccgtgccgggagcaaaaggagaaaaaccggagccaaagcccgtgcctataaaaacaggtagaaagggaggacgcttcatttattactaattactaattacaaactacgagtcggttgtgtcacgagtcccccaaacgaatggggaatttgtacaataaaaaagtaaaagttgaggttgagtatccaccagtctttataggatggtaaatctcaatctcaacttattatttggggttactgattaagctaagtaatcaggttctttttcaccaatcatgttacgcaatgtctgttttaccattctccattgtgtaaacaagtcgtgttcgggctgatgttcgaaatcgtgcatcgggctcttgcagaagaatgacaaccaagtctggatgccacacatgcccgcacgcattgccaagtcgctgaacaacacaaggtcaagagcgataggagctgcaaggatagagtcgcggcaaaggaagttcaccttgatttccatcgggtagcccatccatccgaagatgtcgatgttgtcccatgcttctttgttgtctttgcggggaggataatagttgatacgtactttatgataaacatctccgtagagatccggatatttttcaggttcgaagatagtatcgattacagacagcttgctgacttcttttgtcttgaagttgtccggatcatcgagcacttcaccgtcgcggttaccgaggatattggtagagaaccaaccgttcacacccagcatacgggttttgaacatcggagccaatacggttttcatcagtgtctgaccactcttgaagtctttaccggagataggtacattcttttgtttagagaattcccacatagcaggagtatccacacacaagttaggagcccccattacgaacggagcaccttctgcaatagcagcatacgcgtaacacatactcggagaaatcacgtctgtattgttttccttcattgctttctctaaagcagcgagtgacatgtgttcgtcagacagcggaatgtaaatttcagtacttgcagcccaaagcaccactacgcgttcgcagttgttagcagctttgaagtcgcggatatcctgacgaagttgttctaccatttcccaacgggtagcagccttcttcacgtgtgtaccgttcagacgttttgcccagttgtgatcgaaagcagccggcatcggtttgatagcttccaactcttcttttactccattcaggtctttttctttcaaaacctcggcgtacatagcagcttcgtatgcgttgtccgggaaaatatcccatcctccgaaaacaatgtcttccaaattcgtcaagggcacaacgtccttgatgagtttttcttcgttgttctccatgcgcattgtggctaactgtgtaatagatcctatcggttttgccagtcccttgcgagaggctagtgtacctacaatcatcgtggtagctaccgcaccacccactccgactaccaagacgccaagacgcccggtagcgggtttaatttcttgtttcatttctattctattaaaattaaactaaaattgatgcaaaaataagattaattaattactaatacagtctttatttgtcatataaacattgcaattagcaggatttaacttttaaaaggtcatgtggagacttattctcaagcctgatctgtcaatcccgggcgaatcacgataagtgatcctccagatatagtccaaacgtaacaccttgaaaatgttttcaataccgacacccgcctccacataaggtgtttttcccattgtttgtgtgttttctatcggaaaagcgaacaaaccgtcactcaaagccgggttgtttttatcgctcaaatgtccatataatccacgacaggaaactatttccctccattttagttttttcaacaacggtacccggttgaacagccatccgttgaggaaataagtaacatcccacgagaaatattcatcgttcataaactccatcgcattcatcaacgagtaagattccggttggatggtataagaaaggttggcattaggcatgataagcaacggaaaaggtactttatcccacactttacctgcttttagtataacgtccgtatagccgaacgcggaaaaccagaaacgtttctgaataccggcttcggtatgattgtaagtgtaatcgctgcccaacactccttttccggcaatggtatgagacaaggtaaacaccggtgcatccaacgatacgggaaaacggttccattgggtctggaagaatttctcgttcggagcataacgcagtttcaactctgccgcactgacagagaaatcttttaccggggtgtaggtatctccttctttctttaaaaaaggaatcaggtaggaggactcatctttccgtgtacgcgctgtcaactggaaagaaaagccggaataaaactcattggtataggtcatctccgcctgccggaaatagccgatacggtcgtccttctcacgtttcaaggccaggaacacattgtctttgcttgtatacaggtaattttgtccatactggttcacatctgattcgtaacgcaatttcaatgaatggataggaaattcattggcgtattctttcttcttcttgaaagaatattccagttccgccaatcctttcactctttcatctttaaacccgtaagccacatatcctttgccaaacaggtgcggattgagccaggcggtagtcatacctccggcacggatacgggggccttccaatgtgttaccgctgatagtggcattcatcgggccgatatagaaaagtggtgcttctttggaggtgggaatatatcccgtaaagagaatggaaagcactttctccgtccagtaatacaccggataactgcgtaattgtgtcatcaggcggtctaccgagttttcctgctgggagatggcggcttgcggacgattctccgcccagaatgattcgggacgcgacagggcttccgtctcttcaataatacgttcgggtttggtgaaggctttgtcggcttcagcagtcggcgtaaaggtgtagttgctgtaatccgctacccggcgggcaaaaataccgtcctgtccttcggtcagtttaaactcaacagtgatactttcatgatcgagcaggcgtgtgccgtcttcagcgcgcttaaattcctgttcgagcaacatgtagtctacaaagttcaggtttatctttttgggaaagttgaatacggcacgtttaacaaagtaggtagagtcgagcgtcacatacaggtgtccgttgaaaccgaaagactcggaattaaaaggcgtgaaagcgaggtctgcacaaagctctccggcaatctgcaacgtgtccatcaggtaatatttataaaagcctgtgccgatacgggacaagggactgacaaacttattcgtaaacagggaaatgttgttttcgtagatatcgacgtctttgaagacttcattgatggctgcctgcatcccttgtttagagagaaactcatcgacaccggcctgtttgcgtcctttcacccattgcttctcggaacggggagatttccggtaatagtctgtggcaagcagttcacgggctgataccgtcagaatcggtttaccggtaacggcagaagtatctacatattctgtcaggaaatcaaatttacgatatagccattttttctgtttctcttcatcgaagttattcaacgcaaaggtggtcttttcataacgttcgcgttgccagaagtctttctcgtagggagagtagttgtcacggctttcaatcatgcggcggacaaattctacggcgggattatctttcttccggtagtgctcacgtttgggtttgactaccacttcaccaagcgcgtattcggtaggcgcaagtgctactttataggatgcattacgggcagggcgaatggtgcggacatagtcattatatccgattacagagattacaagcactgcttcggagcggtgggttttgaagtaaaagcgtccgtcgcttccggtagtagttccttcggtcgtgtcttttaagcgtacagatgcataaggcaaaggttctttggtcagagaatcagtcaccaccccttgtaccacatactgcgcactgagcggaatactgatagccaataaaagaaagagcgtcaatgtgccttttttcattaatctcataccttaaatcctattgaattgagcggggcaaaggtaggagtgatttcaagacaaaaaaaggtctatttgacggaagaaatgttcttatttgacacaattaggggaaagtaatacggaatcgggtcagtccgtcggcataggttcgcaaagagaatgtgcacccatgacgcatcagtacttcgcgaataaagatgagtccgattccctgaccgttcggtttggtagagaagaaaggactgaacagtttagcttctgtttctttgctgattccctgaccgttatctatcacttcaacagtagccggagcgagggtgcggactattatttccccatcggcttcaatgctttccgctgcatttttgatgatatttacgagtacttgctcaaacaaagcggcatccagcatcacatctttcacactttcgtctatttccatgcggagtgtaatgcgacggtcattacacattccttccataaaccgcttgcaggtgaaaaccaaatcattcagattaacagaagaaagtgtcggttcggggattttcaccacatcggcaaaacgggtgatgaaacgactcatcgagaaacaacggtcggtacatacacgcatcacgtcgcagatgtcttccattccttcttcgctggaaagggcttgttctaccgtatccagtgtggaagtaatgccggcagtcgtgttgttcacttcgtgggcaatcatgcgaatcactttctcgtatgctttcttttccgctttcatcacttcgtcggtgagggtttctaccaagtagaagggatgctgaaatccacgatcaatgaaagaagaatgagtacaccggtagatattcgagtcgttcagacggacggttaccttctctcctttcgggaggttagccaattccaccgctaacggagaatcaatctctttcatcttcttgccttgtgcgtcttccaaacgaacacccagcattttcaaagccatcggattcaattccgaaaggtcttcatcaagggaagttataatcactcccatcggagaagctttaatcagcaaatcaagaaaattattctgttcacgcaggcggagacgttcattcttgagctgttccatcatgcggttgaagatattcaccacacgatcggcctcatattgacctacagggctaagacggctactgaaatcctgctcacgcaacagttccatgccgcttccgattgtattcaacggcttcacgatcttacgatagaaaaaggtcagataaatgaggatgaaaagtatcagcccctcccctatgtagaaaaagattgtattcagttgactggaaaggaacagcaatacactacctaatgccagcagcagaaagactagtatgtaaaagaatccttttatacgcacgttatctgtggttaacggttaatcttaatattattaggcacgtacctaaatctatcacattgttatattatatttttcgagacggcggtagagtgctgcacgactgatacccaatgccgtagctacctgactcaaatttcctttgtaacggtccaacgcctggagaatggtctggcgttctatttcatccaaagtcataccagccagagctgcgccttcggtcactcttgcgtcatcgtggcgaatatactgcgcatcaaaatcggaagcatcaagcagcggtttaccacttaccaaaatggtacgttccaccaagttcttcaattcacgaatattccccggatagggcaaacggctcaagaattgcagggcatcggcagagaactccgtacgaggcaatccgttggttaccgcctgacggtcggcaaaatgacgtgccagcaagggaatatcttcgcgacgttcgcgcaaggccggcagcttcacagttatcagattgatacgatagaagaggtcttcacgaaaagtacgttcgcctaccattttgcgcaaatcggcattggtggctgataccacccggatatccgtcttacgcggacggctgtcgccgagcacttcaaatgtctgatcctgcaatacacgcagtaacttcacctggcacgaaggatcgagatcacctatttcatccagaaaaatcgtccctttgtttgccatttcgaaacgtccgatacggtctgcggaagcatcggtaaaagctcctttcttgtgcccgaacatttcactttcgaacaggctttgagagatacctccaagattcactttcacaaaggggtgtttggctcgctgactattaatatgaatggcctcggctatcaattccttacctgttccgctttcccctgtaatgagaacagaggcattggtctttgctatgcgggcaatcgtattcaacacatccatcaatccctggctacgcccgatgatgtggctgcggtcgaaagaatcgctctgttcctgcgttggttcctgtggagtgcccgaaagttggagtgccgtttcgatgcgttgcaacaaggcggcattattccagggcttcgttatgaaatcaaaagctcctgcctgcattccttgcacggcaagttggatacttccccaagcagtcatcaatatcaccggtgtttcgggacggaatatttttacttgtttgagtagggtcaaaccctcctcacccgttgtagaaagagtgaagttcatatccatcaggattaaatccggagctacggaacgtactacttccatagcttcccgcggaccgggaacggtctgtgcttcatatcctgcccgcttcaacatgaagctaagcgaagaacgcactgcgctgtcgtcatcaattatcagaatcatagttaaaattgcaagattcctctaccaagaaaacttcttctgttttttcaatcttccaagaagaagtatttctttttttatttctttctttatttataatgggggatgaatttttctgtattatttacgtatttttcatttcccgagtgttaaaatcgagtttcaaaggtactataaatagttcgtaataccaaatgaatcaggcataaatacgcaatagtctgtttgcagacttgaaaaacttttcccataatctccggcaagttcctccataagattcaaaagctttttcctcccctttctattgccggatgatttcatcaaaatcagcttcaagttcggtattggtacgaaaatcccatagtgtcagactgcgaatctgataataataataccaataataataaagttcggaaatatgtttctgtctcgcatcatctttagagttctgcgcatcattcaaatccaaggtattgattttacctatcaggaaagtttcaatacttgttttatatcgttgctgggctatcgcatcggcttctttggctatgtccaattgctgtgcctgattattgaaatgctccaccaacagaaaaatatcctggttgaagtttatctgttcctgacgaatttttgaaagcactacatcccgattactcttggctacccggactttcccacggcgttttccccaatcgagaatcggaatcttaacgcctacctgaacaatctgattgtcctgcaagttcctgtaaacggccggaaaattccggttctcacccgtataccctacgcttgcaaacaaatcgacactacgcaaatttccgcgtgcagtagctacttcataatcggcttccaactggcggcgacggatattctgtgcaaaagaattacgttccaatgctttatttaacacctgattgtactccatcctcgggccatccacagcttcgggaagaaccgggtttagtacttcatcctctcctactcccaaaaaggcacggagctggaacatcttggcattgagatcactctctgcttccgtcaatgcagccttcgcattcaaagcggagagcttcaactgcaagagttcattctcggaaatctgccccattttgcgtttggcaagggctacttcataaaggtggtcggcgtttgtctggttctgtttcgccgtgccaagattttcttttgccaacaaaagattaaagtaataagtgatggcacgcatcgtcacttcttcggtagcagtgataaaagctgctttcgcttcggcataacgaaccggttcgatgcgtctgttccactttatattattgactccaaagatgggttgtgtaagttgtaatgtgacaggaaccgacataaaatgccggtctcctccggttcccaattgcttgatatagtcgagagaggaagtcagcgagagtttaccaccggtaagccagatattttgatcgatagaaagatcaccggtaagccccaatgtgttattacggacgaaaccgtaagaaccgtccgaattttgataagaactatacgatttgttataattaggcagggttccggtcaggttgacttccggcagaagatcggcacgaaaggtacgaaattcccaataggccgttttcaattcattcaaggcaacagcagcgtcaacagattgaatacgcgccatagcaatagcttcattcaaggttatttccctttccttctgtgccgacaatgccaacggcaggcaaacggcagcaagagcaaacaatatacttttctttttcattatacacagtattttccactatgagagaatcaaacgatgtgccaaaaaagtaaagtttttattatcaacagattagaaaataagaaaagtgtccattttcggacactatgcccaaaagtgaacgttcgattattcgcagtagttaggaaggcgcacagtgaaacgagtgcctttacctacttcggaggtgacggagatggtaccattcagacgttcgatgatggtctgacaaatacttaatcccaaacctgctccttgggtgaaattatcgactttatagaatcgttcgaatatatgacggataccttcttcagaaataccgactccggtatcctccacaaagatgcgggtgtagccgggaacctcatcatcttcatagccaaaagtaatgaaaccgctgctcgtaaatttagcagcgttatttatcagattattcacgacttgctgcaagcgtacattatctgtcgtaagatatttcttatcactttcgggcatacgcaacaccagttctactcccggtggcatattcaagcgttgagaatcatggacggtctttaataacagcggcaggttatgctcggcgaacataaattccatggttcccgattcgatacgtgacaaatcaagaatatcattaatcaaagccagtaacaggccgcaattcttattaatggttccgataaactgggcaatctcttcgcttgtaaaaccactcgtatcgcttagcaaatcggagaaacctacaatcgcattcaacggagtccgaatctcgtgactcatgttggcaaggaacgccgatttcagtttgtcagcctggagggctttatcacgagcctctctcatctcctgctcggcagtcttatatcgctggatactctggcaaacacctaatatattgtacaatgaatcttgtgtcaatcccgtgattacggaagaacgatattcccaccattcatactctccgttgacattccgctgacggaaattcagatgggtattggaatcttctcctgtcaatgctctattaaataacggacttatttccttcaaatcatcaggatggatagtgcgatccatttcatcacgggagatggtagtaaccgattcatcgtatccaagacgtttcaagaaaccttgcgggaaaatgaaacagttggtttccatatcaaactgccacggatagatggagctttcgtctactgccatatcaaagaaacgcttctgcatttcttcattcgaaatattccgtgcggaaagtgccataccggtaatcgtatcctttgaacggatcgggactatttcccccgacaccgggaagtatttatcactatgcacttctttcatgaaagctccctggggtatcttcacactttctcctttagcagctacctgcttcagcatagaatgaagaatatcctgaccgttataatatatcttgaagatgctgcctgccatcattccttcataaaaacggccccctgactcatacggcaaatgcagcatttgtaataaggagcggtttgtgaaatgaatgtgcaaatcggtatcatacgttatcacaccatcacggatggaatgaaatacattatcaaactcattacgctgttccacaagtttattctgcacgagcagacgggtctgtgcctgaatccgtcgtttggactcacgccggttggcacgcatcaaccacacgatagaagctatcagcaacgccaggatagacggatagagcagtataaaaaggtatttatatttttcccaatacggttcgttgacgatggttccgctagaggatactttatcagggtcaatatgaaaataatccaactgtttatagtcatagatgaatccctgcgtgatttctgtcactcctatttcttggggagatgtatcttttaagactaaagcagccctttgagctgccgataatgctgaagcataactatcggaatcgtatgcacagaatacgccattagttaaccccacattctgactcgaaaatacgggagcttttgagtttttgccaacgaatgaaaggaaaggcgaccatttaggagcaaccaccagacgttcgtagctgttacgagggtaacaaatagcagcaatgatgtgactcgttgtatgattttgggtattatagactttcattctataatccggattgtctttttgaaagattttccactcttcttcaaaatcttcaaggcctttgttactcaaaaagctgttatctatcacacataccacttctttccgctggggaaatatcttttgcgcctgacgcaatatgacatcaaaatccggattggcagtgaacccgcaaacattgggatgagtagcaatcagctccatatcaggatacttaatgccgaaaaacacgaccggtatctgcaaaggcaacgaatctccacaggcaaaaagagtatagaaagcttcatcacttgctgttataatcaaatcggtctgcctgtcacgagcacgctgacaaaaacgacgcataattactttctcggagttgaatgcccaaaaatcggcatcaagatactccgttgttatattcaccttcaggccactttctttaaatcctttgaccaacccctgattaaggtcgctatgccaaggagtctgtgaggtgtatgactgtataaacaggatattgtatgtacgttccgctgctgccgcctgaataagaacagcaaaaaacagaacgataagcaaacaatagtagcgtcgattcatataattaaagcctgcggtgttttcaatattatgccgacaaagatacgttaattatattgaaaacaaacagatagcccaagttttttattcttcgcgcaacgcctcggcagggtgtatgcgaattacctgacgagcaggaaaccaaatgccaacgagaatcattaaagacatcaggaaataggttatgacaaatgtaataagaaaacgcactactccccactccatatacccttcagtcaactccagatggccgatattataacagatgacggcggcaggcaaagcagccagagtcaacaatagcaatccttctttatttaaacgttgccaaagctgcatccggctggacccgactgctatacgaagcgcagactcggcacgacggtgctgcgtacggaaccagaaggtgccgacaatgcccaacaggatattaagcaataagaatcccatcatccagaaacgtacctgtacctgattatagctctcttgctggaaatcattccgtatatcttcataatcatgcactttcaagatgaataagttgccgacactcaactggttgacagacaatttcatcaaatgttccgcaaagtctttagaagtccccggcttcacacgcagacaaacttctacacttgaaggataaagttcatcgtcaagttcgaccattatcttttcaggaagttcaatggctacataccgatcactgtagttaggccaaaagtcattgtaacgcaccttcttcgaaactccccctatcttgtacactttcgtagaatcatccacatcgaccatttctttacccaacagcgtacgatcgcctttataatctttgggcaagaaattttcaccaacaacgacattgccattccttaaagcttgcaccaacggctgataaccactcccatcagcactttgataacgaaagacctgaaaaaagtcaggggttaccgaacgccgtagcggattactaactaatgtatcgatacgtaacatactaccggagttactcccgatatagggacgcgcattattggatattgaaacggcctccacttccggcaatctccggagacgattagtcaactcgataatatcttgtcctaaagatgtactcttttgctctttcgaaagataggaattactcttgtcgtttttcaggcttagctccaaataatacgtatcggtaatatcaaatcctaccggttcgtaataagtacgcgctgtcacatacgtccagtcgaccacataccacaggaccacaaaaacaattaatagttctgaccacaaccacccgtttgaccggcgctcgttccatatttgttttaatagttgcattttctttagaatttagatgagttgaagaattatctttcgttgatggcatccacaatattggtgcgagttactctccatgccggaatggcggcacttaataaattgagtaggaagcaagccagaaatgccagcaggaatacggtaggatcgaacagtaagtcgacacacatggtccgcaaatcctccacaccattggatacaaagtctacggagaaaagcattcctcccaaaaggaaagcggcgacataacttaataccagtccgagaattcctccgaacagggaataaagcatattttcggatagtacctgcatcataagctcccgtctgggggcaccaaaggcttttcgcactcctatttcggagatacgcttacgcatgcgtgacaaagtaagtccggacaagttgacggcaggaacaatcaataagacaagtaatgtcagtatgtattgccgtactgcttctttcacagcaggaggattgttggcggaatagcgttgcgcggctacgaaataagtatcaggctgtccgcgatagagtaaatcgaaattgggatgccctgccataaagatagcccgcaagcggtctgcctcctgacgaatagccggaaaatcgtctttcgatttagccagtatatagacggcagtcatacccatgatattgtcatcgccccaagtggctgtgaaggcacttgttgaactcaaaggaatccaaacttgcgcataggcgtatttcgccagtttagagaccggacgtaccactccgcaaacaatataagccgaatgattcagaaggaatgtttttccaaccacttctgacgttccgaacaagcggcgagccatatcttcggaaatcacagcttttgctgctccggcatcaaaatcggcattatcatacggtttaccggatagaaactcaaattcaaatattttccagaaagcctcgtctgtttgcaacacactacaactttccatctcacctgccggtttagcagccagcattgtttcctgccagatattggttatggaaactgcttcgggaattgtcattgctttgaaacaagcctttgccgtattgtatccgatagggccattgctttgccaattcacgttggacttactttgaagtccggcaaaccggaaaataagcatccggtcacgatgggtttccggtgcaaagggagcaatagtcgcacgtaaagtaatcacaattaccattatcatagcaatagccaaagctgtaccaataatagaaatagaagaaagcagtttattttctcccaacagatggaatgcttgtttaaaatagagttttatcatgatcgttaccagtatagagttcagtatatttcttacccgtcttttttattcttcttcgattaggttccacagaagttcgtcaaagaacgttccatattagaaattccatcccttctttgttatatccttacatttcaggtttttgtgattgattttaccaacaccatcctttttaaagaaagcagtatcagccttacccgataaagtgatattacctactccatccactttagccttgataaggccacagtcaacattcattttcatattgcctactccgtcgacatcgagtttcagttcatcgcaatgaagatttttcacgttgcaatttcccactccgtcaagttcgaaagctatatttttaagattcaatttttcctttgcatcaaagttccctaccccgtcgattttcactttactcaaatcgggagcagtgatgtaaaaagtcagattcttgacattctttgcattcttctctttataatcgataaccagtgtaccgttcttcaccgttacccgggttttctctacaaattcagaaggcccttccaaacggcaggtacattctgccgattgagcgaaaataatatttccgacagattgcagattgatggcagaaaagtcgcctacattataatctttactcacattttgtgccgatagcgaacaaaaagcaacacttaacaggacagctatcgcaacgataaaaatattctttgtcatggtggtttttaatttagagaaatattaatctgtttttctatttagttttatgtataaaacgcaggttctactgcacctgtcgtccgtcaaagaaacgaatggtacgcgaagtctgctttgcctgttcttcattatgggtgaccataacaatggttcgtccgtcttctttattcagtcggtgaagcagttccattacttcggctcccatccttgaatccaagttacctgtcggctcatcggcaaggattatttcaggattaccgataatagcacgggcaatagctacacgttggcactgaccaccggaaagttgtgtaggaaaatgtctcatacgatggcttaaccctactttttccaatacctcttgcgccaaccgctttcgctcactactgccaacacggcgataaagtaaaggcaactccacattatccgtcacatttaacgaattaatcaaatggaaagactgaaacacaaaaccaagcgttttattacgaaaaacggccaattctttgtctttcattccttcggtacgtattccattgatttccactattcccatggtaggtgcgtcaagtaatcccattatattcaacaatgtagattttccgcacccggaaggtcccattatacttaggaattctccacgttctaccgtcagattcacattttccaacgctaccgtttcaatctcatcagtacggtaaattttggaaagagagttcaatgttatcataacttctagtgtttaatttatttaatcttcagcttattcttgttcttatatgcactcatatcacttaccactaccctgtcacccggttgcaatccactcaaaacttctacatattcaaagtttgaatcacccaactgtatcttacgtttgaccagttcattgtcagagttgcagacaaacaattcgtattcaccacgccccacatagaaagagccattggcaacacgcatcacatcttcctttacagcattcatcacataaacatccgtcttcaatccggagcgcagacgacgatgattatcttccttcaactgaaccgtgaatgatatgacgccattcttggataacggtgttacactgctgaccgttccttccagtttatcgcttcctatcttaacaattgcttttcctccagctgccacacggtcgccatacgtatcagcaatctcaccttctaccttaaaatgacttaaatcggaaatgatagcgacttgttcgccttcggaaatctgcgcaccaatctggttattaatataggtaagaatagctctgcgcggagaacggatttgcgcatcatccaaagtacgtttcttttcggagaggctcttacggaagatattaaaatcgagttcctgcaccttcagttcggcggcagctacttccttctcatttttatattgctgttggagttgttcgtattctaactgggctacattatagctcaattcagcctggcgcactttatccgttgttcccgcaccgagactgtccaaatagtgttcatttctcaactccaccttcatccggcttaatttcatagccgaaactttgatctgcatcgccatatcggaaagcttcgtctgattattgacacgaagctgatcgagcttataccgacgcatctgctcttcgtccagcaactttttatattcggtttccgtactctgaagatcgagtttcagaatcggagtacctacatctacgctatctcctccttttttataaacttcaagaatacgactgttgattggagaattgattatttcttcaaatgcaggaaccaccttgccggaagcactgacacttacctcaataactcctgtatcgactgtggaaaagacaagatcttttgcctccactcctgcccttagtacagatataagtacaccaatgacaacaatacttgccaccccgatggatgaataacgaatgatcttcttattacgttctttctgacgtatttctttaggaatttctctgtccatatctgatcgtttacgattttatcatgtatcaatttagcatttcatataccaaatctatgccaaaaacgtaagtaattgataaatagaatgtaacaaaaaacaaagggtgtccgatatcggacaccctgtacgaatttactgttcagaatatgaatctatccacctgtcggcggaaggccagtacacctggataatgacggattgtcaactacggtataatgacttctcattgactattttttctctagttcggaagcttgctgaatctcctgcggagagtgttgcttcggttcctgtatcagttcttttccccaatgattagtctcctccagtttttcacgatcacgaatttcttttgctttacgggcatagacaatcatacgcatggattgatcgtaagtgaaataattccagatccaatttaagagcacaatcactttattacgcactccaaggatagaacgtagatgaacaacgagccacatcacccaggcaaaccatccctgcatctttactttactaaactctgccacggcacgattgcgcccgacagtcgccatcgaacctaaattgcggtaatggaaaggtttcatttcctgtcctttctccatacgaatcagattctttgccaatagttctccttgctggatcgccacttgtgccagttgaggatgcccgttcgggtaattttcatcagccaactgaatacattggtcgccaatagcaaacacattattcatcccttctacacggttgaatgaatcgactttaatacgtcctccacgcccaatcagagaggcatccagattgccgatagtcacaccggtgacaccactcacccagataaaagtacgcgtggcaatctctgtaccatcttcgagtactactttatggtcacgataatccacaacacgtttattcaacaggatatttactcccatttcacggagaaactgttcagcatgtgcagaagattcttctgacattccggcaagcaatcgcggcccggcttcaatcaaatagatatgcatcagactgctgggcatatcaggataatcattcggcaagacgaatttcttcatctcggaaagtattccggctacttctatcccggtagctccacctcctacaattacaatattcaatagctcttgttgttcctgctttgttgaacaggtcagcgctcgttccagattagccagaagagcgtttcgcaatcccatcgcttctgacacatttttcatcggcatggcttcctcttcgatatgtttattaccgaaatagttggttgtagtacctgctgctaacaccagatagtcatattctgcttttccgatggaagtctgtatcatattcttttccgggaaaatggcacgtacttccgccatacggaaatagaaatctttccgatgctggaatattttacggaaggggaaggatatggaagttggctccataccggccgaagccacctgataaatcaaaggaggaaactgatgatagttgtttttatctatcaatacgacttgaaagcctgactttttcagcttgttagccagtttcaagccaccgaaaccaccgcctactatgacgacacgtttcttattactttttgcaatgtttagactcatattctaatcatgttttatcaagataataacacatgaatgagtcattaagtttccgaaattcgaaacttttgagagaagtctctaccgcagacgcaatctatctccgatttccggaacatactcaccatccttacgattcatcttatacagatttttgaggcggataccatatttttgagagatgccatgcatggaatctccatctttcacaacatatacagtataaggtttggaagcctttttcttcttgctcttcaggtagatgatatctccttccatcaaggtataatcacgctgcaagtcgttgtacttcacaagtttcctccaactaatatcgaattccttgcctaaatctttaaaggtatcaccgttgcgggctaccacataagcaatatcattagcgatatacacctgatgcgggctcatcaaccaaggattctttttcagtttccgttccgaatatacccccttacggtcgtatttatacaagtcataatcttcgataattgtaatcagacgattagcataagaaggatcggtagcatagcctgcttttttcagtccacgcgcccagcctttataatcggtgatgtccagtttaaaaagaaaagcgtaacgggcacctcttctaaggaagtcggaatgatcttcgtaagagtcacgcggatgcttataagcacggaaacattcgttacgggcatcatcatcatgacgaaccgtacgtccccgccaactgccaccacacttaataccaaagtggttattactctttcgtgccaactggctgtatccggcaccgctttccagcaatccttgtgccaatgtaatactcgccggaatcttatgaagcttcatctgttcaacagccaaatcactatacttatttatatactcgacgtaacgggcattccgtttctgtgcctgcactcctacggcaaagaaaaaaacaacggttaaaaagataagtctatgcagtttattctccatttttattcagatgtgaattagatggcacaaaaatctgaaaaataattgggattatcaatctctttcctaactttgtaacattaattgtagaaaccaataccctgacgtatatgaaagacctcacaattaccgctattattaaagtatatcaatatgatgagttgaatgagggcgatcggtcacttataaagactgccatggaggcaacagctcgtagttattctccgtactcccatttctccgtaggtgccgctgcgctattgggcaacgggacagtagtgacaggaaccaatcaggaaaatgcggcctatccgtcggggctttgtgcagaacgtactaccctattctatgccaactcccaatatcccgaccaaccggttgtcactcttgccattgcggcacgaacggaaaaggacttcatcgaccatccgattcctccctgcggtgcttgccggcaagtgattctggaaacggaaaagcgttacaaacaacccatccgcatcctattatatggcaaagaatgtatctacgaagtaaaaagtataggcgatctactgccgttatcatttgacgcatcagcaatggaggattaattatgttacaacaatatcacacgaaactaaaaggaacactcgcacttacagactcttatctgacagaaaaagcactgcaaaaagaaaaagggctttataaatttatatgggtacgcaacggaagcatcacagtagaaatcgaccatcaggaaatgatacttacccaagatgaagtgatttcactcactcatctgcaacacctcgaatttaaatcgattgatggtgaatacctgactttgttgttcaacagcaatttctattgtatctatggcaacgaccatgaagtgtcatgcagcggtttcctgttcaacggttcttctcacctgatccgttttaccctgaatgaaaaagaacgtaaagaactcgacaccattaccgaagcactggaaaacgagtttaccgtttccgacagcctgcaggaggagatgctacgcatcctgctaaaacgtttcattatccaatgtacccgaattgcacgtcaccgcatgaatatcacccgtgaaaaagaatccggttttgagattgtccgccaatactataacttggtcgacgagcattaccggacgaagaaacaggtgcaggactatgccgatatgttgcataaatctcccaagacactatcgaacatcttttctacctgcaaactgccttcgccgcttcgggttatccacgaacgggtggaagcggaagctaaacgtctcctgctttacagcaacaaaagcgccaaagagattgccgatattctgggatttgaagaccaggcttctttcagccgtttcttcaaaaatatgactggacagagcgccgtgcaattcagaaacacacaggaagggaaaaattgacaaggcatacggaagtattgctattttgggggtagtggaaatggacgacctttgcaacataagataaacccattaaaaccccaacaaaatgaaagagaaattgatcgctttactgaccttcacttcaagtctgaaaagttttggtatgaaatttatccgcgttgccatcctggtagtatttgtatggataggcggattgaagtatttccattatgaagccgacgggattgttccgtttgttgccaacagtccttttatgagtttcttctatgctaaaggtgcacccgaatacaaagaacataaaaatgcggaaggtgcttttgtcccggaaaatcgtgcatggcacgaagcaaaccgcacttatactttctcttacggactgggagctcttattatggggatcggcatactggtattcttgggaatctttttcccaaaagtgggattggcaggcgacaccctcgccattatcatgacgctcggcacactttcttttcttgtcaccaccccggaagtctgggttcccgacttgggaagcggagaattcggtttcccattactatccggtgcagggcggttggtgattaaagacattgtgatcctggccagtgccgtagtgttattatccgactcgtcacaacgcgtactcaaaacacttaaaaaagactaagacaaccactaaagaggattctgacttcttgccattgcggaacaaatcgtattttcagactgttatatagtctcatacaaatcattaatacaagaagttatgaaacaatatgatgcaattattataggattcggcaaggcagggaaaaccctggctgccgaactttccaaccgcggatggcaagtggccatcgtagaacgttccaacatgatgtatggaggaagctgtccgaatgtagcctgtatcccaacaaagacgctggtgcatgaagccgaggtttccgctttgctttaccacgatgattttccgaagcaggcgaatatgtacaaacaggccatcggccgaaagaaccgcctcacttcctttcttaggaatgataattacgaaagactaagcaaacgtcctaatgtgactatctatactggaacggggtctttcatatccgccgataccataaaagtggaacttcccgaaggagaaatcgaactgaaaggaaaagagatatttatcaacacggggtctactcccattatccctgcaatagatggtattcagcaaagtcagcacgtatataccagtagtgcgcttttggacttaagtgtacttcctcatcacctgattatcataggtggaggatatatcggactggagttcgcttctatgtatgccggtttcggcagtaaagtgacgatactcgaaggaggaaacaaatttatgcctcgcgaagatcgggatattgcaaacagcgtcaaagaagtgatggagaagaaaggtattgaaatccatctgaacgctcgtgcacagtctatccatgacacgaatgacggagtgacactgacttactcggacatatccgacggtactccttattatgtagatggagatgccattcttatcgcaacgggacgtaaaccgatgattgagggattgaatctgcaagcagcgggtgtaggagttgatgctcacggagctatcatcgtaaacgatcagttacgcactactgttcctcatatatgggcaatgggagatgtgaaaggcggatcgcaatttacatatctctcgctggatgatttccggattatccgcgatcagctcttcggcgacaagaaacgtgatatcggagaccgtgatcctgtgcaatatgcagtgtttattgatccgccattggcacatatcggaatcagtgaagaagaagctctgaaaagaggatattcatttaaggtttcccggttgccggcttcctccatcgtccgtacccgtacattgaggcagacagatggtatgctaaaagctatcatcaataatcataacgggaagattatgggctgtactctattctgcgccgatgcttcagaaatcatcaatatcgtagctatggcgataaaaacagggcaaacctctacattcttgcgcgattttatcttcacgcatcccagtatgagtgagggattaaatcaactgtttgatgtataagaataagaaagagtataactcacttctaaaacagagcctctgaatagggtaaacagaggctctatttggagtaatcggaggctctgaatgaggtaaacggagcctctaaataaatgaaattcattctttttcagtcttaatagagtgaaatctaatagaaagtgttatctttgccgccaagtaaaactatatacctaccgcaatgagaattactaagtaagacaacacttctaagtaaacatcacttttcttatatgctttttctattttgttaagcatcacgaaatccgtgttgtttagccagtattgtgtttgtcgttccccctatcctgtgtttttttcactctattttcaacctcaaacccaatagatcgtcatgtctatcagtatccaacaaatcagctatatccatccggataaagaagtattattcagtgacctcaatttcgccatcagtaaagggcagaaattgggattagtcggtaacaatggttgtggcaaatctactttgctacaaattattgccggacagttatcaccctcttccggtgtcattgtccgcccggacgacctatattatatcccgcaacatttcgggcaatatgattcactgaccattgcacaagctcttcaaatagagcgtaaacagcaagctctgcacgccatcctggcaggagatgtctcaaacgagaatttcaccattctaaatgatgactggaatatcgaagaacgttccatcgccgctctcgatttatggggattaggacagtttacgctatcctacccgatgaatctgcttagtggcggcgaaaagacccgcgtattcctggcaggtatggacattcatcatccatctgtcatacttatggatgaaccgaccaatcatctcgattcttccggcagacaacgtttatatgactgggtagaaaaatatcgttccaccctgttggtggtaagtcatgaccgcaccctgctcaatcttctccccgagatttgcgaactaaagaagcatcaaatcaattattatggcggaaattacgaattctacaaagaacaaaaaacgctgatgcaggaagcattacaacaacgtattgaagaaaaagaaaaggcactacgtattgcccgtaaagtggctcgcgaaacggccgaacgcagggacaaacagaatgtacgcggcgaaaagagtaatataaaaaaaggagttccacgcattgtattgaacgcactccaagggaaatccgagaagagcaccagtaaactgactggcgttcatcaggagaaagccgagaagttaacaaatgaacgcaaccagcttcgaggttcgctctctccgactgctgcattaaaaaccgacttcaatagttcctcgcttcataccgggaagatattagtgacagcaaaagagattaacttcagttatcattccaattcggttaacaatgatattctgacgaatgatgaaataaattcgtctgacacaggttatcatcccaatccgaatagcaatgatattcaggaaaatagtatctcaaaacaacagctttggcaagctcctgtcagttttcagctaaagagcggagaccgcctccgtatagaaggagccaacggtagcgggaagacaactctattgaaattaatcaccggccaacttcaaccacaggaaggaaccctgacacggacggactttagctatgtctatttgaatcaagagtattcgatcattgacgaccggaacagtattcttgaacaggcttacgctttcaacagccggaatctgccggagcatgaaataaagattattctaaaccgttacttgtttcctgcatccgaatgggacaaatcctgccggaaacttagtggtggtgagaaaatgcgtctcgctttctgctgtctgatgattagtaacaatacccctgatatgtttatcctggatgaacctaccaacaatttggacatacaaagtattgaaattatcactgctactatcaaaaattatgcaggtactgtgatagcaatctcacacgacaattattttattcaggaaattggtgtcgaacaatgcattttattgagttagtctattgatattttatccagggcaaccgcaccaaaatttaattcatatccgcacagttttgaataaaataatgaagtattctggaaacgttgtggtaaatctgaaaaagatgattgagtttttaagattccccgttatctttttattataagatatgggtcaaaggtgagggttggtgagggtagatttataaccttttattttattattttctatactatctccttttttatctataaaaaaaatacgaaagttataaatctaccctcaccaaccctcacctttgacccatcattagcgcaccgtttaacttgtttcagtacagttcttaattaaatgggaatctatcggttaaatgagaatttatcggttaggctgaaagccttacaattatatatttattggggtgccctgaaagggcttaattatatagcgtagggcaacgccctacgaaaaaaacacaccagccacaagccctgaaagggcggaactgtatacaattatgccctttcagggcgcaaattcagattgtcgtttttacgtagggcgttgccctacgctatataattaagccctttcagggcactccgcaaaattatcatttatccgacggttcaagtctattttattatcaagagatgaaagaagagatgatatgcgcttttgttcatttatgcttggtgctacaaatgaataattcctcattgtttccaatgacacatttttaatcgttgtacctgtagctaaatgcattatgctattcttgaactgttgggaggcaacaacgtaatatataaaattcaagtcgaaatcttctgcaacattgaagtaacaagcgcttttacccaagatgcacgcttctccttgatattttgcgacattaccgattgtaccattgatagaaactaatatagttcgatggtttagatttttcctatacttattagcttcatcttctgacacacgctttgttgaatcttttatttcgatttttccatcaacaagattattcccattgataaaaaaaacagttccatttttgtcatattttggggtaccatgtaaaccatcccctaaaagggtggtcacatcctttaattgatattttttccactgttccataaatgagaatttatcggttaaatgggaattttgcagttaggctgaaagccttacaattatatatttattggggtgccctgaaagggcttaattatatagcgtagggcaacgccctacgaaaaagacacaccagccacaagccctgaaagggcggaactgtatacaattatgccctttcagggcgcaaattcagattaccgttttttcgtagggcgttgccctacgctatataattaagccctttcagggcactccgcaaaattatcatttagctcatttctgcacggttatgaatcaaattttggtgcagttgccctgtattttatctgataagtctaaatatcaatctagtttttttataacttcgcagcgcgaagatcaagaattagaattaaaatgaatcagacagcacaatcatggtggtttatcttttacaaagaccaactgcttcttgagaaaaaagaggatggtatatatgccatcccgtgtggagaaagctctcctattgttattaaagaaaaaacaaccgtacacaatatcactacactggaagagagaaactgcaaggctttctccctctcctctcccattgaagaatcggagcaatggatcatgatagggcttcgtgcctgctatgaatatcttcctttgtctcattatcagacagcaggaaaagcacatgagattctgcattgggatagaaacagccgcttttgttccgcctgcggcacgcctatggaacagaaagaatctatcatgaagcgttgtccgaaatgtggccgggaagtatatccttccatttccacagcgatacttgtattagtgagaaaaaaagattcactactcttagtgcatgcccgcaattttaaaggaacattcaacagtctcgttgccggatttctggaaaccggagaaacgctagaagaatgtgtagcacgtgaagtgaaagaagaaaccggactggatgtaaagaatatcacttatttcggtaatcagccctggccttatcccagcggactaatggtcggctttattgctgattatgccggaggggaaatcaacctccaagatgaagaattgagttcgggagacttttatacaagagacaatttacccgaacttcccagaaaacttagtcttgcccgaaagatgattgattggtggatagagcatccaaatgaataaatcaaacatgaaaaatatcatcaaaggaatccgtcagtattatccggtatccgacagttctttggaagtactcttcagctatatgaagaaaatggagcttcctaaaaaacatttactgatacacggtggagtactagaccgccacgtctactttattgaaaaaggattttgtaggtcctattgtttacgtgacggagaagaaatcacgatctggttttcacgcgaaggtgatattacctttgccatgaaagatttatatcataatcaaccgggatacgaatatgtagaattactggaagattgtgaattatatgccatacgcattgaagatttaaatcagatttatgaaactaatatagaaattgccaactggggacgtgttattcatcaggaatgtttgttgtacatggatattcaccatatcaaccgattgtatcttccggctaaagaacgttatgaacaacttttacgtgagcaaccagatgtcattcaccgtgcccaattgggatatatagcctcctttctaggcatgactccccaacatcttagccgtctacggtccgaatcttgattctttttaatctatgtgaatttttatatcacaagaaagcagtacttttgtcagcgaatacaaaaaaactgataagtatcgtgattaacacattaacttctttacgaatattatttgccttgatggtattcggggcacattgttatgttctggatccgagcttcgacacacacttctttaaagaaggatttgttggagtcagctttttcttcatccttagtggcttcattattgcctataattatgaagaaaagttattggaaaagatcaccaccaaacgtacttttgggtagcacgcattgcccgcatttaccccctccatctacttactctattaattgccgcatgtataggagggtatgttcaatacaacgatacgacagactggataaaacacttcgccgcttccacttttttattgcaaccgttcttcccttctgcagattattttttctcattcaatagtccttcgtggagtctgggctgcgaacagttattttatttctgtttccccctcatcattcctttcttaaatagtaaacggaatctatgcatcactcttttcatctgcctgctggttatgctgacaggtatgcatctgactgctgaagaacaaattaaagcatactggtatgtaaatccaatcacccgcctgccggacttttttgtaggtgttttactttatcagttttatcggtcgatattcaacaaaaagatttcttattccaccggaacactattagaaataggagtagtcattttattttttgttttctatttttgtaccgcagacattcccaaagtataccgctattcttgttactactggctacccgtttctttggtgatacttatctttgccttacaaagagggtatatatcccggttactatccaatcgggtcttagtgataggaggagaaatcagttacagtttctacctgatacatttatttattatactcacatacacccaaatggctactctgtatcaatggcacatgcattggatgataagtgtccccgtcattttttgcatcactattgcgcttagcttactttcttattattattttgaaaagcctgccaatagatgggtaaaacgaatactaactaaaaaataatcataaattagccccatggaattatcaacaaaaacaccccgaattgaagtagtagatgctcttagaggatttgctgtaatggccatccttctggttcataacctggagcatttcattttccccgtatatccggaaagttctcctgaatggctcaccattttggatgccggagtatttaatgcgacattttcactgcttgccggaaagtcttatgccatattcgctctgcttttcggattcactttctatatccagtcgcacaaccagcagttgaaaggaaaagattttggttaccgctttttatggagaatgatattactggcaggattcgccactttgaatgccgctttcttcccggcaggagatgtcctgcttctgtttgttgtagtcagtcttgtgctgtttatcgtacgtaaatggagtgacaaagcgattctaatcaccgccatcttgttttcactgcaaccgattgaatggtttcattatataatgagccttttcaatcctgcctataccctacccgatttgaatgtcggagccatgtatgctgaagtagcagaatacaccaaagccggaaacttttgggattttctgataggcaatgttactttaggacagaaagcaagcttgttttgggctatcggtgccggacgtttcttgcagactgccggacttttcctgtttggcttatatatcggacgcaaagaattgttcgtaactaccgaatctcatttgaagttctggatgaaagcacttattattgcagctatcagtttcgcgccactgtattctctgaaagaacagatcatgcaaagtgacagcagtttaattcagcaaacggtaggtactgcctttgatatgtggcagaaatttgcatttacgattgtacttgttgcttctttcgtgttgctttatcagaaggatcagttcaagaaaactgtatctaatctgcgattctacggaaaaatgagtttgaccaattatatttctcaatctattttgggagccattatctatttcccattcggattctatcttgctccttactgtggatatactcttagcctgattatcggtattattcttttcctggcgcaggttcggttctgcaaatggtggctgtctaaacataaacaaggaccattggaaacaatatggcataaatggacttggataggcacgaagaaataacagaaaaaaagaaatagcactgactgaaaaatagactaaaaaagcaggccacgaaatacacataactacaaacgaacaacttacgaatatgaaactgaacgtatcactctaaagcatcaacaaaacatgtgtatccgcagcctgcgggttgaaattgagatgatgtcaatacaacaagattcgggcaagaaggattagcaagtggacttaaagaatgcaaaggaaatgaaagaactgtgccaagttggggaaaaagcccgaaaataggcagaatcagagctatgtatagagaaaaagaagcgcctccataatcttcgaaaagaccatggaggcgctatttatttatctttcgttatctatatctgaaatttcagaagaaacaaaatcagatacccaatgatttcttcactgcttcaatcttttccattgcagcagattcggcagaagcataacaattgcggcaacccatttcaccctgaacttccatatagaacttaatcttcggttctgtacctgaaggacgaacagaaactttgctaccgtcttcagtgaaatattgaagtacgttagatggttccggcatatcgattgcagttacgttacctttatcatctgtctgtttcagtgtcttataatctttgctcaagatcactttagagccacccaattctttcggaggattggcacggaagttctccatcatagctttgatttcttctgcaccactcttacccggtttcactacgtttacagtaaactctttagagaatccgtattctacgtagatatccagcaacaactgatacaaggattttccattatcttttgcccatgcagcaacttcagcaatcaaacagcaagctgatacggcatctttatcgcgaacgaaatcttcggcaaggaatccgtagctttcttcaccgccaccgatatatttctgtttgccttcacgcagacggatttcacgggcaatccatttaaatccggtgtagcagtcaagcatttcgatattgttcttatctgcgattttcttgattagttcagttgtaacgattgtcttcacgcagaactcgccacctttaatcttacccagttgtttgtactgtgtcagaatataataaaggtacatcatacaagtctgattaccgttaatcagtacccattcgcctttatcatccttgcaagcaatacccacacggtcagcatccgggtcggaagccataacgaggtcagcatcaatttctttggcaaggtttacagccatagaaagagcttccgcgttttccgggttcggagatacgacagtcgggaagttaccgtccttaatcatctgttcgggcacagtaaatacgttttcgaatccccacattttcaatgcacgaggaatcaacatcatacctgtaccgtggatcggagtatagacaatcttcatgtctttgtgacgggcgatagctgccggatcaatagaaacagttttcaccatatccaaataaatcttatcgatgtcttcaccgataatctgaatcaaatccggatttccctggaatttaatatcggcagcagaagcaattgcattcacttcgtcgatgatacctttatcgtgtggagccaatacctgtgcaccatcgtcccaatatgccttgtaaccgttgtattctttcggattgtgagaagcagtcagaatgataccgctctggcaaccgaggtgacggatggcgaaagacatttccggtgtcggacgcatgtcgtcaaacagatatactttgataccattggcagagaaaatattagcagaagtctccgcaaacaaacggctgttgttgcggcaatcgtgacctactactacagaaatctgcggcaggtctttgaagttctttttcagatagttggaaagtccttgagtggcagcacctaccgtatagatattcatacgattgctacctacacccataataccacgcagaccaccagtaccaaattcaagatctttgtagaaagcttcaattagttcggttttatcatcgttttccaacatacgcttcacttcagcctgggtttcagcatcataagccggggttagccatttttcggctttttcagtgacctgtttaataagttcctgattttccatttcgattgttatttattggttaatgaattatttattatcaatttcttgagcacacaaatgtaaaataataagtttataattcctattcttttaattgaaatttgagaattaagaattaaaaagcgatatacttaatacctaatatctcatacttaatatctattcttgtggcactttatatctgtcaccagtctgcttgacatattcctgcaagaattctttcggatatccgggacgcatcactccggcaggttgtccaatagaattacgctcaaactgaccgtctttaacacgtttcaccactccatcattgtacttcacaatcaagaatgtacccaattgtttccaagtatcgaaagtgctctgtgcggtcatatttgtatagtttgtcagaaagtcaaccgctgcgttcttatcttttgccagcagtttggcagccatttcttcaatgccttcctgtgcattgttgaaagtagtttccatttctttctgcgcttcccgtacatcaccgatcatcaaatcataacgcggatagaccatattagatacccagttgaaaatccagaaagcagaattccaggagaaagtaatataatcggccccatctacacgggtataacataccggcactttagtagcacaacaataaaccggggtaaatacagccatgttcgcatcatccacaccaaaccaaagtacaccgcctatcgggtccggcttatgagcccgcatttgtgcaacaaatacaaacccgctttgttgagtggaaatcggacgttcgttgaaatattcctggccatctaccttgaagttcagaggagaaagacggtaaggtgtcttataaggtccggctccaaaatcattggagatgtcaaggggcgttccttcataatggtcgcgcatcatatctttcacatcttgcacggataacttatgtttcggtttcacaaaaagaggcatcggcgtattggtctttccctcaatgtaaggaagataatcttttccgttatccgtaaacttattaaaatagctccacacacgagcctcacagaaacgacgggcaccaaaatcaagaggcgcataggctaatgagaaactaaagtctttgtttactccattaaaatatcccttctcacgggcaaaagaaacgacatccggagagtacatacagttttccttgtcgttcatatcaaactggtggatacgtgactggttggcatgggccgaaatacaatcatcgggcacacgtacagctacccaaactgctccacggatgccgggacctttaccaatcatttccataatccatatttcgttcggatcggcaatagtaaaggattctccttcgctatagtagccgtattgctgcactaagtcggtcatgatcttaatagcttcacgggcagtgcgcgaacgttgcaaaccgatataaatcagacttccgtaatcgataatccctgtagaatcggccaattccggacgtccgccgaaagttgtctcaccaatggtaacctgatattcattcatattaccgactacattgtaagtctggcgtgcctgctctatttctcccagatacttgccggtatcccattcataaactttcagcatcgtaccttttggataggtagcagccggataatgataaagttctccgaataagccgtacgagtcggcagaataggaaacaatcgtcgagccatcggcagacgcattttttccgacaatcaggttggtgcaggcgaaggtgttcgccacagccgccatcaatacggcggcacaaagaataattcttctcttcataataaatatatgattcacttttaataatttaccaaataaagctttcacgggccactgtttcattcccacaatagtcggtcactgtaaattcaacagtatgcttgcctcccttctttacgcgtttggggtccaacgtacattcccagtatgatttcacaatattgggacgtccgaaaagcgcatactttccgtcaatcgttccacgataggaagcaattcccgcgccctgatctttcaaacgatagacaatttttccgtttcttccccactgattcttgttgacagggataatctccggcgggatggtatcgatggcaacagtgtaagttcccaactcccggatagatgctttcatgtatccgtcttcatactttccgcctacgctgtactttcctcctttgggagttatgcgggccacataatatttcgtcgtatcggcaattggttttctacgcaacccgatacacagttcacaagctgcatgcagcggaaccgccttatcattcagctgataagtaaaagcaacggcaccactatccgccttcacctgataattgaggggaacatcatcatacaacattcctttcggaacaaccaggttcaatcccggttcttgcagataattagtcttattccaggtaaaataatatttctcccgatgattcaacggttcaatcggctgtttccgaccccgtacggtgaaactatatttggaagtgtttccgaaagcatcttttaatgtatataagaactgatagtcccgttcctcatcaattgtcaccaagccacggttatcattcgatgcttttagcagacgcaaagtgttgcccggatcaatgaaagatttcatatattgcccgtaagtccaggaattaatcatccggttctcttcctgcgagaaacgatctacggtgctacgaaatatttcatttccatctaccgtaagcacaactgaataaactccataatggttattcactccatccatgtaatcgtatgctttgatccccacacctatcactccccatgcttccaccggacgctcactattgggaaggatggttttattctcttgctttccatccactactcctttacccagttgcggaaaaaatagaatgccatccgctttcggagcacgcgtatcttttattttcgattgaaagaaaggcatagggtcaatataatctcccgattccgtttcaaatacatccaggtgaagatgcggaccgaacgaatatccggtatttccgctccatgcgatctgctgacctcctttcaccggatattctcccggttcgggaacaatctctacttcccagctttcttcttcatattgaagtttctccaccctttcggcaatgggagaaacaaaaccactcaaatggcggttgatcgttgaatagccattgtgataacagacatcaagtacatatcccgaaccattcgtgacgcgaatacgcgaaatatagccatcagcgagagcacgaacgggtttaccgataactccgcctgtcttaaaatccagtccgccgtggaagtgattggagcggatttctccaaagttcccactcaatgtaagaggaaagtcaaaaggaggtacaaaggttacttgcttcttctcttgtccataccctccgatgcagcaagccagcatcaaagcagtgatatatcgtctcatcattccgttcacttttttactcccgcaaatgtacactattcccactaaactatgaaatatccgaggagaatgatgaccgtagatactagttaatatttctttttaatgttatattcattgcaaattagtagtcattatgttatttatattagtacttttgtagccgttttttaattataattaaaagttagaaactcaatgagaatgtatgtaaaagtaatggcagcggtcattgcatgtatattgctgagtggagaagcgctctcggcatttgcaactacccccgctacagaaaatctgagttggtttaaaaagaaaaagaaaaaaccagaagagaaagaagagaagagtaaaagcgactacgagaaattagtggaagacagtaaaacgaccaaagggatgtttgctgtacatcaaaagaagaatgattattattttgaaattcccacctcacttttgggacgtgacttattagttgtcaataagctgcaacgagttcctaccgaacttaatgatgcgggtgtaaaccgcggagtaaactatgaaaaccagatggtttgcatggaatgggacaaagcgacgggcaaactaatgttacgccaacaacgtccattacctctggccccccaaacggatgctatcttccgttcggtaaaggataattttatctctccgctgattgccgcattcaagatcgaagcagtcaatgcagattctacggcattagtaatcaaggtgaatgatatttatgatggtacggaaaccagtatcaataacgtatttaccaatattaatctgggtacttcggctatcaagaatttatcacgtattctatccatcaaatccttttcaaacaatgtcgtggcaacttccgagttgactacccgggtaacggaaggtactactactgtttatgtaacggtggaagttagttcttctattctcttattgcccgagaagccgatgatgggacgattcgacaatcagaaggtcggttatttcacgaatccgttattaagttttagtgatgcgcagcagcgtacggataagacacagtatatcacccgctggcgtatggaacccaaaccggaagatcgggaggcttatctgaaaggtcagatggtggaacctgccaaaccgattgtcttctacattgataattcaactccttaccaatggcgttcgtacattaagaaaggtatcgaggactggcagattgcctttgaaaaggctggtttcaagaatgcgattatcgccaaagaaatcacggacagtatgcatgtagacatggatgatgtcaattactccgtactgacttatgctgcttcagaaaagaaaaatgcaatgggaccttctctgttagatccccgttccggagaaatcctggaagctgatattatgtggtggcacaatgtgctttctatggtacgtgaatggattactgtccagaccggaacagtgtgtccggaagcacgtaatgtacaattgcctgatgctttgatgggagatgccattcgattcgtcgcctgtcatgaggtaggccactctctgggactccgccacaatatgatgggttcatgggctttcccgacagattcattacgttccgaagcattcacttccagaatgaactctaccgcttcatctatcatggattatgcacgattcaattatatcgcacagcctggagatggcgtgaaagttctttctccgcatatcggtccatacgatatgttcgctatcgaatatggatatcgttggtacggaaagagtactccggaagaagaaaaagatattttattcgatttcttgagcaaacatactgatcggctttataaatatagtgaggcacaggacgtccgcgatgcggtagatccacgtgcacagaacgaagatttaggtgatgatccggttcgctcttctttacttggcattgagaatcttaaacgtatcgttccacaaattcttcaatggactactaccggtgagaagggacaaacttatgaagaagcatctcgcctctactacgctgtaatcaaccaatggaacaactatttatatcatgtccttgccaatattggcggtatctacattgaaaatacaattgtaggagacggcgttaaaacttacacattcgtagagaaagagaaacaacaagcttcactgaaatttctgatggatgaagttttgacataccctaaatggctgtttgacacggaagtggggcaatatacttatctacttcgcaatactcccatcggaaaacaggagaatgctcctacacaaatcttaaagaacgcccaagcctatatcctttgggatttacttggcaatactcgtttgatgcgtatgatagagaatgaatctgtcaacggaaagaaggcctttacagtagtggagcttatggacggacttcataagaatattttcggtgttaccgaacgcggtggcatccctaacgttatggaacgttctttgcagaaaaacttcctcgatgcattacttacagccgctgcagaaccggaagctgttaaaatcaacaagaagatcgccaacgaacatttcttgcttgaccacgctactcctttctgtagctgttacgctgccgaacaacgtgcacttcgtcaggaagagcggatgggggctccacgtgtgctcaatttctatggcagccagctcaaccgtatttcagatgctatttctgtgaaacgcggtgaattattacgtatcaagaagttgttgcagaaccgtctcggaacttccgatactgctgcacgctatcattatgaggacatgattctgcgtattaatactgctttaggaatcaaataaaaccacttattactttaactatctacattaatgagaaaaaaatacttgtgcattcttatatgcctctttgcaaatgcgctggcctttgccagcgctgctaatcgtacaatcaccggagtcgttatatccggtgaagataatgaacctctgatcggtgcttccgtatatgttaacgcagatgacttaaaaaaggccggagcatcacagacttctctaggtactatcactgatatggatggtaaattctccatttccattccggaaaaggtgactaggttacattgtagttatataggatttgaagaacaagacatcgttttgcaagcaggaaaagatacttatcgtattgtacttcaagcttctgcacacacattgggagacgtcgtagtaaccggttatcaagaactggaacgtcgtaaactgactgctgccattgccaaagtagatgtaacagatggaatggtaggtgctgcaaaaagtatcgaccaggcattagcgggacaaatcgccggtgtggctgtaacgacaacttccggtgcaccgggagctccagcacgtattcgtattcgtggcacggcttcactgaatggaacacaagacccgttgtgggtattggatgggatacctttggaagggactgatattccagaaatcaacaaagataacgataatgacatcgtaaatatgtcacaatcttctatcgcaggtttaagtccaaacgacattgaaagcattacgatattaaaagatgcagctgctactgctatctatggtgcacgtgctgcaaatggcgtaattgtggtaacaaccaaaagaggaaaaaccggaaaacctgttattaacttcaatactaaattgacttatactccaaatctcaatacttcacgactcaacttactaaactcggaagagaaagtcgatttggaacttcaattgttaaaagaagcacggtttgacatattatggggattaacagatccgataccggtatttcctgaaaaaggaaaagttgctgctatcatgaaacaatataacttaatagacatctataaagaacaggggtggaacggactgacacctgaagcccaaaatgctataaacaaactgaaaacaatcaatacagactggaatgatatattattcagagatgctttcacgcaagaatataactttagcatttccggtggtagcgaaaaggttacttattacaactcacttggttatgtcaaagaaaacggaaatgtaccaggtgtaagcatgagtcgttttaatctgaccagtaaaacgtcttaccaaatcaacaaaatattaaaaattggaatgtctatttttgccaacagacgcaagaataacacatttatgactgatacttacggacttattaaccctatatattattcacgtatcgccaacccttactttgctccgtttgacgaacaaggaaactacctttacgattacgacgtagtcagaagtagtgaaacagatgaaaagcaaggctttaatatattcgaagaacgagcaaacaccaataaagaatctgtcaccacagccatcaattctatctttgatgttcagctacgttttaacgatcagtggaaagtttattcacagattggtgtgcaatgggatcaattgtcgcaagaagaatatgccgggataaattcatataatattaggaatatacgtgaaaccaataaatattggaaaaatggtgtacaaacctatcttataccagaaggaggcatgcttaaaacaactaatagtacaacctcacaactcacatggaaaatacaaggagaatacaaaaacacatttggggatatacatgacatacaaataatggctggttcggaaattcgcaaaaactgggtagacaaccaagcctcaaccggatacggatatgatcccaagaaactaacattccagaatctcatatttaaagatgaagcacaagccaatgattggaatctaaaaactaaatcgtacaaggaaaacgcttttgcttctttctttgccaatggttcatatactttaatgaatcgttatacattgggaggaagtgtgcgcatggatggttctgatttattcggagtagataagaaataccgtttcttaccaatctattcggtaagcggtttgtggcgtttatctaatgaatcgttcattagacaatacaaatggattgataatttagctcttcgcctttcttatggtttacaaggaaatattgataagggaacctctccattcctagtcgggaaatatgataatgtgaatattttacctggctacagtgaagaaaatattattatcaatagtgctcccaacagtaaattacgctgggaaaaaacagcatcttacaatttaggaatggatttttccgtactcaatcaagccattaatcttagtgtagattactactatagaaaaggaacagacttaattggttctaaagcattagctttggaaaatggattcactaatatgtctataaactgggctagtatggaaaataaaggtgtagaagtaaatctgcagacacgtaatatcaccactaaaaacttctcttggtacactactttcaacttcgcatataatcaaaataaagtactaaaagtacttacagataaaagccaagtgactcctagtctggaaggatatcctgtaggtgcaatctttgccctaaaaacaaaaggtataaatcctgatacagggcaaatctatcttgagaataaagagggcaaagctgtcactgtggaagaattatttagaatgacatcaaatgaagacgggcttggcacttaccaaataggaccgaatagcgaagaacaaagagatttctacagctatgtcggaacgtcagacgctccctatacgggcggttttctaaatacgttcaattaccgcaattgggaactgaacctgaatttttcttataattttggagcacacgtaaaaactactccaagttataatgtgtctgacttagatccaggacgcaatatgaatagagacatactggatagatggacaccagaaaataaaacaggaaaattccctgcattagcaacgtataactacaatccggctgactactacttgttcagtactcgaaatgacatttacagatcactggacatctgggtaaaaaaactaagctttgtacgcttacaaaatattcgtcttgcttatcgggtgccatccgaatggctgcataaactaagtatcggcggagcaactgtaggattagaggctcgtaacctattcgttatcagctctaattatgataattatatggatccggagtcaatgggcaacctatactctaccccagttcccaaatccattaccttcaatctaagtcttaacttttaaaaaatatattatgacaaagaaaatatattatatattcacattaataggaagcctgttattatcttcttgtgatagttatttggacatacagccagtaggccaagtaattcccaatacgctagctgaatacagagctttattcacaacagcttacaatacagcactcaatgacagaggaatatgcgaaatcagaacagatatcgcaaccatattacagtctgatgccacttccaaaaattctttaggagatgttgaaaaatggaatgatgttaatccgaatgcaagtacgagacaatttggatgggcggcctattataccaatatctattatgccaacgcaatcatcgataaaaaggatgaaatatcagaaggaagccaagaagatattaatcaattagttggagaagcttacctcatgagagcatatatgcactttatattggtcaacctttatggacaaccttatacagctgccggagcattagaaaccaaagcagttcctctcaaactcaatactgatttagaagaaataccatcacgaaacactgtaaaagaaatatatacctccatattgtctgatatagaaacagcaaggaaactgattaataaaaaagaatgggaagttcaatattcataccgtttctcaacattgtcagtagatgctatggaatcacgggtatatttatacatgggtgaatggggcaaatcttatgaatcttcggaacgtgtactagccggaaaatcaacattagtgaacctaaacgatgaaggagacaaacttcctaatgaatttacatctgtagaaatgatcactgcctatgaaattttcccgaatagcgattatgccggatcactcttactataccctgcatttttacaagaatatgaggaaggaaaagatctacgcccaaacaagtactatcaagcaaataaaaatggagattatacttctatcaaaagtggtgaatctagattcaaatgtactttccgcactggagagttttatttaaattcagcagaagctgctgcacatttaaacaaattgcctgaagcacgttcacgacttctaaagttagtagagaatcgttatacaccagaaggttatgaacaaaagaagaatgaaataaatgcgatgagccaagaaaagctaatcacagaaattctgaaagaacgcgctcgtgagcttgcttttgaaggacatcgctggtttgatttacgccgaactactcgaccagaaatcaaaaaagaaatagaagatgtgacctacacacttgtacaagatgattcccgctatacattgcgtattccacaagatgcaattgatgccaatcctggattattaaactaataacatattaccatctatactctcatagatatcactaaataacaaactataaaaactctctttaccaaaagcgtaaggggagtttttttattctgtccactaactactttatattttatctacacatctcgtccatcgctaaatctttatccccaaaagaattgccgattaacagaaaatccatatctttgtagcgacttattacgattaataacgtagaagcgtttagaatattatctctattcagaatctggtaaattctttaattggggagataatggcaactaagcgttcacgtctttgttatatgcaagggcgtggactctgttgttcatttcccaataggtttaccagagccttgaatagaatgaactaacgacgtccacgcttctcttgtatatatatggtatccggacgcttaccacacaaacaataaagaaaatgagcagcactattacaaagttcttcgcttcttttttagcttatggggtagctaataagaaaaagcgcttctcggccattggccgtttctctgaaggattggcaccggttaaaggaaaaatccaatggggatacattaataaagaatatgacattgtcattcctctaatgtatgaacgggctttctcgtttaaagaaggattagggatggtagtactcaattctcaatacggattcatcgaccataccggacaaatacggattccgtttaaatacgcagccgctcactcgtttgagcaagaatgtgcacgagtatgtcaggatggattatggggactgattgacagacaaggaaactacattcttccaccgacttacaatcaaatagagcaattcgcggaaggattagccctcgtctcactacacaacaaagttggattcattaataagaaaggagaagttgtcattccgctggaatatgataatggatgctctttttctgaaggattagctgccgtttgcattgaaagccagtcgtccaagtggggatacataaacaaagataatgaagaagtacttccttttaagtacgatattgcagaacccttttataacaacatagctcgagtgggtctctatggaaaaagcatgaaaatcaacaagcagggcagtgaatgtctataaaacaaccactctacgcatttattcatctcaacacgcgaagacattctgttctaaaacatccccttacgaacaacaacgtaaggggatttttcgtactttcgaacatgttaaatctttaatacgcaacattatgattatcggagtaccaaaggaaatcaaaaacaatgagaaccgtgtaggcatgacaccttcgggagtggctgaagtggtaaaacaagggcatcgggtatttatccaacatacagcgggaataaatagcggttttccggatgaagcatatcaagctgtcggcgcacatatcctgccaacaatagaagatatttacgctactgccgagatgatcgtaaaggtgaaagagccgataatcactgaatataacttaataagaaaaggacagttactattcacttatttccattttgcttccgacagggagttaacccttgccatgctctccaacaaatcaatatgcctggcttacgaaactgtagaagaagcagaccatacactacctttattaattccgatgagcgaagttgccggacgtatgtctattcaggaaggtgcccgtttcttggaaaagccgcaaggtggaaaaggtattcttttgggaggtgtaccaggtgttaaaccggctaaagtattaattttaggtggcggaatcgtaggtagcaatgctgcgcaaatggctgcgggaatgggggcagacgtcactatcacagatataaatctggcacgtttgcgctatttgagtgaaacacttcctaagaatgtaaagacattgtatgcatccgaactaagaatcagaaaagaattgccggatgttgatttagttgtcggttccgtattgattcccggcgataaagcaccacatctgattactaaagagatgctttcgatgatgcaacccggcacagtattagtagatgtagcaattgaccagggaggatgcttcgagacttctcacccaaccacccacagtgcaccgacctatattgtagacggaatcgttcattatgcagtagctaatatcccgggagccgtaccttatacttccactcttgcactgactaatgctaccctcccctacgtgatcgctttagcaaataagggatggaaaaaagcctgcaaagataatccggcattggctctcggactgaatattgtagaaggaaaaatcgtttataaagctgtagccgatgtatttggtttgaagcacgaacctgtcagcctataataaatggaaatttagcggttaaatgggaatttatcggttaaatgagaattttgcagttaggctgaaagccttacaattatatatttattggggtgccctgaaagggcttaattagtcgtcccttaaaaagtactcatctgcgggatattgcaagaaaacagtgtcccgcagataaaaaaacacaccagccacaagccctgaaagggcggaactgtatacaattatgccctttcagggcgcaaattcagactaccgttttttcgtagggcgttgccctacgctatataattaagccctttcagggcactccgcaaaattatcatttagctcatttccgtaccgaaatgaactataatggattacctgcttatgtagttaatcaaaacaaaagtagtaaacgttaagcaattctaaaaagaccacttctttttaggaaagaccttctaatggcctgtcttttatatgtatttgtcgatacacaagactatacaaaatcaggtagaaaaagtttgaatcattttctacctcataatagaagtttatgatgaaaatatcagttataaatataaataattggctaattaattactatttttgacacgtaaatgaaaaacagcgaataacccctattaaaaacttaaaatatgatgaagaaactactcacagccactgctatcggcttggctttgttaacttggcacaccagttgtactcaacaaccaaaggctccggaagcctttactcctatcaaagtagaaactcctgcccgccctgccggacaagaagatgtaatccaactcgttactcctaaaattgataccgtacgtgtcggtttcatcggcttaggaatgcgtggtcccggcgccgtagcacgctggactcatattccgggaactaagattgtagcgttatgcgacctgcttcccgaacgtgttgaaaaatcacaagaaattttgaagaatgccggactccctgcagctgcttcttacagcggagaggaagatgcatggaaaaaactttgcgaacgggatgatattgatcttgtatacatagctacagactggaagcatcatgctgcaatgggtgtctatgccatggaacatggcaagcatgtagccatcgaagttcctgccgctatgacattggatgaaatctggcagttaatcaacacttctgaaaagacccgcaagcattgtatgcagctcgaaaactgtgtatatgacttctttgaactgacttctttaaatatggcacaacagggcgtattcggagaagtgcttcatgtagaaggttcatatatccacaacctggaagatttctggcctgaatactggaacaactggcgaatggattataatcacctgcatcgcggtgacgtatatgcgactcacggtatgggccctgcttgtcaggtacttaatatccaccgtggcgaccgtatgaaaacattggtatctatggatacgaaagctgtcaacggaccggcttacattaaaaaacaaacaggagaagaagtgaccgacttccagaatggtgaccagacttcgaccttgatccgcacagaaaatggcaaaacgatgctgatccagcacaatgtaatgacaccccgcccatacagccgcatgtaccagatagtgggagccgatggctatgcaagcaaatatccgatagaagaatattgcctgcgacctacacaagttgattctaaagatgtgcctaatcatgaaaatctgaatgcacatggctctgtacccgaaaatgtaaagaaagcgttgatggacaaatataaagatccgattcacatagagttggaagaaactgccaagaaagtaggcggccacggtggtatggactttatcatggactaccgtctggcatattgcctgcaaaatggattaccattagatatggacgtttatgacctggcagagtggtgttgcatggccgaacttaccagactttccatcgaaaacaattctgctccggtagaagtccccgatttcactcgcggcggatggaataaagtacaaggctatcgtcacgcttttgcaaaataaaactgaatatatccttttagcacgaacataatgaaccaatccggcttctcccccaaagccggattattcatgggttcgtgtttgaacattttatagattatcataatcacttttatgaaaacagctattccaaaaccttctaagcaaagcattatccgtgaagccagagattatgtaatgattgccatcggcatgattttgtatggcatcggttggaccgtttttctacttccgaacgatatcactaccgggggagtaccgggtattgcttctattgtatattgggctacggggtttcccgtacagtatacgtacttcagcatcaacttctttttattgctactggccctcaaattgctggggatgaagttttgcattaaaactatttttggagtatttaccctcaccttctttctgtccgtcattcaaaagctgacagcaggtttcggactccttcacgaccagccctttatggcatgtgtcattggagcatccttctgtggaggtggtataggggttgctttttcggcaaacggaagcacaggaggcacggatattatcgcagccatcatcaacaaataccgggacatcacattaggaagagtcgtactcatctgcgatatgattattatttcttccagttattttgtcttaaaagactgggaaaaagtggtatatgggtttgttactctttatatttgtagcttcgttctcgaccaggtagtgaatagtgcccgtcaatccgtacagttctttatcatatccaataaatatgaagaaataggacggcatatcaacgaatatccacaccggggagttacgattatcaatgcaaccggcttttatacaggacgagaagtaaagatgctgttcgtattagccaagaagagggaatcacctatcatcttccggttgattaaagatatagacccgaatgcatttgtgtcacaaagtgctgtcatcggagtttatggagaaggattcgatcatattaaagtaaaataaaaaagaaatgaaaaaccaatattgagaaacatgaaatttcgaccaacccccaatttattaacaggcattttcatgggaatattttccctgacaacatttaatgtaatggctgaaaaagccgtgcccccctattggcaggatgtgcaggtagttgaagtcaacaaagagtatccacgcacttcttttatgacatacaacaatcgcgctgatgccttgagtggcaagttcgaacgaagcaagtattaccgcttgctgaacggaacctggaaattctactttgtagactcttacaaaaagcttcccgacaacattactgacccgaatacgaatacagattcgtggaatgatattcaggtacccggcaactgggaagtacaaggacacggaatagccatctacaccaatcatggttatgaattcaagccacgcaatccgcaacctccggctcttcccgaagcgaatccggtgggagtttaccgtcgggatattgatattccggcagattgggacggacgggatatctacctgcatctggcaggagccaagtccggcgtatatgtatatatcaacgggcaagaagttggatatagcgaagactccaaaaatccggcagagtttcttattaacaactatgtgaagcccggcaaaaacgtgcttaccgttaaaatcttccgttggagcactggttcctatctggaatgtcaggacttctggcgcatgagcggtattgaacgcgatgtttatctgtattcacaacctaaagcagccctcaaagatttccgggtgaagtctaccctggatgacagctacaagaatggaatcttcagcttgaatgtcgatttgagaaatcacgagaaggcagcaactaatctcacattagtttatgagctattggatgcacagggaaaagtaatctctactgaagagaagaccgcctatatcccatcgaacgaaatacgtacactttctttcgataagaagctggcagatgtcaatacatggacatccgaacatccgaatctgtacaaactgctgatgaccgtcaaagagaatggcaaaataaatgagattattccttttaatgtaggattccgccgtattgagatcaaacctatcgaacaaaaagctgctaacggaaagccatacgtttgcctgttcatcaatggtcagccactgaaactgaaaggggtaaatatccacgaacacaacccgtcaacaggtcattatgtaacagaagagttaatgcgtcgtgacttcgagcttatgaagcaacataacctgaacagcgtacgcctctgccactatccgcaagaccgccgtttctacgaactttgcgatgaatacggtctttatgtatacgatgaagccaatgtcgaaagccacggaatgtattacgatcttcggaagggtggttcattgggtaacaatcccgaatggctaaaaccacacatggaccgtaccatcaatatgttcgaacgtaacaagaactatccgagcgtcaccttctggtcgttgggaaatgaagccggaaacggatataatttctatcagacttacttgtggctgaaagaggctgacaaagagctgatgaatcgtccggtcaactatgagcgtgctcaatgggaatggaactccgatatgtatgttccgcaatatccgggtgccgactggctggaaaatacaggaaagaacggcagcgaccgtcctgtagctccttccgaatatgcgcacgcaatgggaaactccaccggaaacctgtggggacaatggcaggcgatttacaaatatccgaacctccagggtggatatatctgggactgggtagaccaaggtcttctccagaaagatgagaatggaagagaatactgggcttacggaggtgacttcggtgtagacgcgccgagcgatggcaacttcctctgcaacggtcttgtcaatccggatcgtggtccgcatccggcaatggctgaagtgaaatatgtacatcagaatgtaggctttgaggcagtagatgccgctgccggtatattcaaaatcaccaaccgtttctatttcaccaatctgaaaaagtatcagattcactataacgtactcgctaacggaaagactataaaaggtggaaaagtatctttggatattgctccgcaggcatccaaagaattcaccgtaccggtaaacggcttgaaagcccaaccgggagtggaatattttgtaaacttcagcgtaacaaccacagaacctgaaccgttgattccaacaggatatgaaatagcatacgaccagttccagcttcctatccaggcagagaaagctatttataaagcaaacggtccggcactgaaaacaacgactcaaggagatgagctaatcgtttcttcttccaaagtgaattttgtattcaacaagaatagcggattagttacctcgtataaagtggatggcacagaatatttcaaagacggatttggtattcagcctaacttctggcgtgctcctaatgataatgattatggtaatggcgctcctaaacgtttacaggtatggaagcaatcaagcaaaaacttccacgtaacggatgcaaccatgacaacagaaaataaggtagtttccttaaatgtgacctacttattggctgccggcaacttgtatgttgtcacatacaaaatctatccgaacggagtagtcaatgtaaatgccaaattcacgtcaacagatatgcaggcaacagaaactgaagtttctgaagctacccgcatggctacgtttactcccggaagtgacgctgcccgcaaggccgcttccaaactggaagttccccgtatcggtgttcgtttccgcttgccggcacagatgaacaacgtacaatactttggccgtggtccggaagagaactatatcgaccgtaatcatggaaccctcgttggcgtatataagacaacagcagataaaatgtacttcaactatgtacgtccacaggaaaacggacatcacaccgatacccgttggatcgctttatctcccgccaaaggaaacggcctggttttggtagccaacagtacgatcggtttcaatgccttgcgcaactctatcgaagactttgactctgaagaggcactgccccacccttaccaatggaataactttagtccggaagaagtagccaatcatgatgagaatgccgcccgtaatgtattacggagaatgcatcatgttaatgacatcgttccgagagatttcgtagaggtttgtgtggacatgaagcaacaaggtgtaggcggatatgacagttggggtgcacgcccggaacctttccaccaaatcccggccaatcgtgattaccattggggattcacattagtacctgttcgctcggctaatcaggccaacgaggcggctaaatacgattatcgataaccttagtataaatttttaaagaaaaaacccatgaaagatttatctagcattgtagctaaatttaaagtccaaggtacgatagaagaaatcaaacctttgggtacaggacttattaacgacacttacaaagtaaacaccaaagaagcagatgctcccgactacgttttgcaacgcatcaatcatgccatttttcagaatgtagagatgcttcaatccaatattaccgctgtcaccaatcatattcgcaagaaactaacggaggcaggagaatcggatatagagcgcaaggttttgagtttccccgaaacagaagagggtaaagcatattggttcgacggtgatagctactggcgtgtgatggtattcatcccacgcgccaaaacgtatgagacggtgaatcccgaatattcaaattatgctggagaagcttttggtaacttccaggctatgttggccgatattccggaaacattgggtgaaaccatacctgatttccacaatatggagttccgcctcaaacaactacgtgaagccgttgcaaaagatgctgccggacgggtatcggaagtgaaatactatctggacgaaatagagaagcgtgcagatgaaatgtgtaaagcagaacgtttatatcgtgaaggaaaactccccaaacgtgtttgccactgcgatacgaaagtgaataacatgatgttcgacgaggatggcaaagtgctttgtgtcatcgacctggatacggtaatgcccagctttgtcttctccgattatggagatttccttcgtacaggcgccaacacgggtgatgaggacgataaagaccttgatcgtgtaaacttcaatatggaaatattcaaagcgtttaccaaaggctatctgaaaggagccaaatcattcctgactccaattgagattgagaatcttccttatgcagccgctttattcccatacatgcagtgtgtacggttcttggcagactatatcaatggagatacttattataaaatcaaatatccggaacataatttggttcgtactaaagcacaattcaaactgcttcaaagtgtggaagccaacacaccggaaatgatcgcattcatcaacgattgcttaaagaattgagaatagaggaaaaaagagaatggagaattatctatttggtaaaggctccattcttccaatgataaacaatcggacggcggagaaacggtttcagtttctctgccgtttctgttgacatataatcaggagtagccaatgtaacagtcaattctgtattttctttattaaaatcggctttcatcaataatatatctgccgaacggcgtgcctcgtcaaactcataaacacctgctgaatccggcgtattcagaaagtcgcccatcacaggcagggtaatatagagagatgctgtaagcggtttccagtcatctgtatagaaacggatgctgctgtcgcaggcaggtgcacaagctgtagagactgtacagatcacgttcgtcgagtcattcaaagccaacactttcatctgccaggtagattgagaagacatctgcatacggatataatctttacttagatcagtcatctccgacttcttgccgaaacgattctctacttgcgctttcatcttactttccagaaagtcaatacaatcttcccggtttactttggttagtaacgggcttagagaatccggcatattcacaaacagcgttttggcttcttgtgcccaaagagcggtcgaagcaaagagtccgacagcagaaaagaatatagtgattacaaatttatttattttcatatctatcttatttaacctgtgacaaacagattttgtgtaactgttttaatttttagaccccaaatataagaatatcattccgattaacaccagtataaggtcaatcgctttgctttttaaattcttttcacggaagagaagtgcaccgaaagtgaaagagactactacacttccccgacggaccatcgaaacaatggaaatcatggaatcgtcatagctcaatgcgtaaaagtaaacgaaatcggcagccgaaaggaagatagaaatcaggataatcgtccagtcccagcgaaacggggtggtagactttcttttaggccaccaaagcaataacagaataggacacataataaacacctgataaacattataccaggattgtaccagcatcggattcagagacttcatcagatacttgtcatataatccgctgatagcacctgtaatggcagccaacacaataaagaatatccatttgttatgtttaaaatcaattccttctttcttccccgaacgacttaacataaagaaagagacaatggccagcattaccccaatccattgatagagattcaaccgttcgccaaataccagcatcgctcccacaagcaccatcaccggacgagtggcgttgataggtcctactatggttaaaggcagatgtttcattccgaaatatccgaatatccacgaagacaacacgatgaacgacttgatgatgatatatttatgctgttcccaaccaacaacgggaacattaaatatcgttcctcccaacaggtccggtttatatacggatatcaggataaacggcagaaagatgagactggaaaaaaatgtatttagaaacaaaacgggaagtaccgcattatctttcaacgatttcttcttgaatacatcataaaagcccagcaaagtagccgagagaaatgctaataataaccacatgagaatatttattatttattattcaaatatactttcgggatattccacatttaccagaaacagggcttgccccggagcagatgtcccggctttgcaacggtcttgttgttcgataacccgccggaagccttcaacagtaagtttccctcgtcccacttcaatcagcgtacctacgatagctcgcaccatatttcgcaggaaacggtcggcacggatggtaaacacccaagtagcatcatcttcctgcgtccattcggcatgagtgatatgacagatattggtctttacatccgtatgaagtttgctgaagctcgtaaagtcagtgtactcgaaaagggtacgtgcagcttcgttcatgagtgcataatccaactgattataaactcgccaacgatattgccggttaaaaggatatttcgatgtcgttacataatacttgtaagttcgcgcagtcgcatcaaagcgggcatgcgcatccggccggacccggcaaacacgataaatggaaatatcgggaggtaacaaacggtttaatttatcggcaactgatatttcatccaacggctcatcgaagtcaaaatgagcaaccatcagggaagcatgtaccccggcatctgtccgacctgcccctattacttcaatttcgcgacgcagaaaggtagacaatgctttcatcagacattcctgcacactaatcccattcggttgaatttgccaaccatgatagttggtcccgtcgtaagccaaataaataaaatacctttgcacgctaattcctcattttagggttttcgcgcgcaaaattaatcattttatctcatttatctttgtataattcacataaacctgtatatttacagaacaaaataatcatgatttactaataccccacaattatgagtagtaccattttcctcatcatcgccctcgtcacgacaggcatctttcttattcaattcgtattatccatctttttcggagatatagatgcagatgtagacgtggatgctgatatcagtagcgtagtttcttttaaaggacttacccatttcggaattggattcggatggtacatgtatctggcgggaaacacggaaattcaaagttacataatcggtattctagtgggtcttttctttgtttttgccgtctggttcctctataagaaagcttatcaactgcaacaagtgaaccacaacgagcagaccgatcagcttgtgggacgggaatgtgtgatctatttcaaacaaagcgacagcaaatatactgtacagaccacccgggacggagccatgcgcgaagtagacgtcatctccgaatccggaaaagcatatcagactggcgacagaacaatgattaccagctacaaagacggaacgctattcattcaataattattcaaatacacaattttatgacacaagaaatgttaatcatggctgctatactagtggcagtcatcctactcacttttattggtatcctttcgcgttaccgcaaatgtaagagtgatgaagtcctcgttgtatatggtaaaacgggaggagataagaagtcggcaaagctatatcatggtggtgcggcttttgtatggccgattattcagggatatgaattcctgtccatgaaaccaatgcagatcgaatgtaaactgaccggtgcattatccgctcaaaacattcgtgtagacgtgccgactacaatcactgtagctatcagcaccgatcctgaagtgatgcaaaacgctgctgaacgtatgctgggattaacaatggatgacaagcagaacttaattactgatgttgtatatggtcagatgcgtatggtgatcgccgatatgactatcgaagaattaaattcagaccgagataagttcctggctaaagtgaaagataacatcgataccgaacttcgcaaattcggtttgtatctgatgaacattaacatcagtgacattcgcgacgctgccaactacattgtcaacttaggtaaggaagctgaaagtaaagcactgaacgaagcacaggctaacatcgaagaacaggaaaagctgggtgctatcaaaattgccaatcagataaaggaacgtgaaacgaaagtagcagaaacccgcaaagatcaggatattgctattgcagaaacaaagaaacaacaggaaatctctgttgcaaatgcggataaggacagaatctcgcaagtagccatcgccaacgcggaaaaagaatcgcaagtagcaaaggctgaagctgaaaagaatatccgaatcgagcaggcaaataccgaaaaggaaagccgcgttgccgaactgaattccgacatggaaatcaaacaggcggaagctgcaaagaaagctgccatcggacgaaatgacgcacagaaagaggtagcactttccaatgcagaactagctgtaacacaagccaatgccgacaagcaagccggtgaagctgccgcgaaatcggaagctgctgtacagactgcacgcgaaattgcgcaaaaggaagtggaagaagctaaggcacggaaagtggaatcttcattgaaggctgaaaagattgttcctgcggaaatcgccagacaggaagctattcttcaggcaaatgccatcgctgaaaagattacccgcgaagcggaagcacgtgcaaaggctactttagcacaagccgaagcggaagcaaaagctatccaaatgaaactggaagcagaagcggaaggtaagaaacggtcattacttgctgaagcggaaggtttcgaagcaatggtaagagcagccgaatcgaatccggctatcgctatccaatataagatggtagaccaatggaaggaaatcgccggcgaacaggtaaaggcgttcgaacacatgaacttgggaaatatcactgtattcgacggaggaaacggtggaactagcaatttcctgaatacattagtaaagacagtagctccgagccttggcgtattggacaagcttcctatcggtgaaactgtgaaaggtattattaatccggaaagcaaaacggaggaaaagcctgcaactaaagctgacgagaaaaaagataagaaatagttgtaatccgacataatatacgctgatgagaaaagaatgattacttgttctcatcagcgtttgttttttatataattcaaataaatctttgaatattccagatttattacgttctttgtgttacataaaacatgtaacgtaaaatatgtaataagtcatgaagccatacaatccattccttgtatacggttacaacagtcccgaatacttttgcgatcgggagaaagaaactgataaaatgatttcagctttactaaatgaacgtaacctgaccttaatatccccccgacgcatgggaaagacgggactcatcaaaaatgtattctatcaaatgaagcgggaaaataatccgaatgctgcctatttttatatggacatttactccacacgtgatttaaaagcattcatccagttacttgctcaaaatgtacttggagaattagatactctgtcccaaaacatactccggcaaatgactgctttcttcaaatcttgccgtcctattatcagcgctgacgaaagaagtggtatgcctaccgtaacattagactttgctcctacccacgctgaacaaacattgaaagaaatactcaattatatggtagcctcaaagaaacagtgttatcttgccattgatgaattccaacaaattacagaatatccggaaaaaggtgtagaagcattgctccgctctcatatccaattcatgcccaatgtacattttatcttttccggaagtaaaaagcatgtaatggaagaaatgtttacttctgcaaaacgtcctttttatcaaagtacccaaatcattgtattaacggaaatcccactggagaattattattcgttcgcacactcattctttgctaaggaaaaaagagagttgacactagaaacattttcttatttgtaccaacttgaaaacggacacacatggtacgtccaaagtatactcaaccgattgtatgaaaagaaaatcaaccccattgataaccgactggtagatagatgtataaacgacattttagatgaacaggaaaccatatatcaaagtaacctgactctactaaccaacaatcaagtagatttattgaaagctattgccacagaaggctgtataaaaagcataaatgccaatgacttcatcaaaaagcatcatttaaaaacgcccagcagcgttaacgtggcactaaaatccttactgaataaagaactgatatataatacaccagatgggtatattgtctatgaccgttttttcggaaaatggctgaaagatgcagtaatctaatacgcactagaaatgattggttcttaatcaaattccgtgctacttatttatgttcaataaccttattcatggctattccggggtactttaagatgcatatagcttggataatttatttgctatttctaatatgccgatatccctttatccatcaacctttcaatgagctttactagcacggaatttgaagaagaaccaaatgatttcgcgaaatcatttctcatgttctcatacttcacatgataattatctgtaattcaaagcaatagcactatgagaaatactttttaaaaaggtgtttctcatagtattttgcctgaaatgtcataaaaaaccggtatttctcatactttcatcatgcatttctcataccggaactgctatataatacctacataataaatgtcaacccaacccgaagataaaaaaaaggcagccaactattatcagggtattacagcccccggtagtcccacatattgtgggaaaagattccctagctggagagaatttattccctcattttgagggaataaattcccataatataagagaatactttcccacaatatatgggattaccggaactaacggatatacttacccaagatcatagtattcgatatattcatcatattgaggcgtttctgtaactcccctctttcgaaaaagttcttgtatatacttttgttcctttggtttaatcaaccgttctttattgcaacaacgataatagatcgttttgccgaagtaggctatcatctgtcgcttgataacggtggcatcagcaagcggcacccgatccagcaaatgtttcattccccgtgcaaacaacaccggcttttcatcaataaagtaagtacagtcttcaccatcggaggtgacatgttcgggattaataaccattacagcagcccgctctttcggcattcggagagttacttgtcgtcgcagacatttgtccgcacgcaaacaatgtccattcaagcaatgagcgaagctaacgggcatagaattgtaatcgaaatctgttttcatgtgtgttatgtttagtggaaagtggcctatttttataaaccgctacaaatgtatgaaaatagctggaggacaagaaataaatacactatttacttcaacacattgataaaatctttatatttgcctccaacatcaatacaggaacttataaaactatatctctcctgcaaaactataaaacagaataatcatgaagacaaaacatttacctggagcactactgccatttctctatacaattatcttttttagctgtggaaataacgatgaaaaaaagatatattctttatccttcgaaaaagagtattacgaacgacctttgttaggaacaaccaatatcaccatcacaggtggaaacagggactacaccgtaactgtagaaaaaactgacattttaaatatagatgtagatttgtccagttcgataggaatgggaagcttaagggtcaccccaaaaaagaaaggagaaacaaaggtgaaagtaaaagataatatcaccaacgaaacagttgatttaagaattaaaataacagacagctatttggcgtacgctatagaaaaaagtaatcatccggcactttccaatggcactgtagtttatctgattaacaatgaagctaaagaatgctattttttccgttatattgagtttagagacgaactatctcacactccaatagcaaaaggaacatacgactttttcaccaagttagaaagcggttccggcaactcgtctcctacatacgccataccttatttaacattaaattatacatctgacgaacaagaaaatttcacggatgcatcagttccccccacccctcacaaattaagatttgagctatacgatggggttacgagtgcaaatgctgtcctaaatcttatatcaagatttctaggtgtagattggaaagaacttgtagaaaaagctcttaccagaagcgaacatacaatagtacccacactaaaaacaacaattgacaatacagattataccataataggtatattaaatacctatcctgaaataccagagaatattttggaataacctcaaaagtatggaattgaaaataatgcaaagcatggaacgtatgaaaaaatagcgtatatttgcgagcaaaaaatataaaatgactatttataagcttcgcatattaccgctatttttactagttattgggcttacaacgcttacttcgggctgcaaaaagaaagacatgtcgctgaaactgaatgagccacgcaatattcgtggcgtcgtcagctataaacgttctttccctgatttgaatgacgcacatctggaagtagccaaaaagatagggattcacccattggcagaccgggaagcagcagaagatatgaaagaaaagctaactcatattaccgacaatgagttttatgtagtagattcactgacacactccatcccctatctcgtaccgcgtgccagtgcactgctcgatacaatcggttccaactttctcgattcattggcagccaaaggtttaaaccccaaccaggtaatcatcacttccgtattgcgtaccgaaaacgatgtgaaacgcctccgccgtcgcaacggaaatgcttccgccaactcggcacactgctttggagccacctttgacgtcagttggaaacgttttaaaaaggtagaagacaagggtggaagaccgttacaggatgtaagtgccgacacactgaaacttgtcttgtccgaggttttaagagacctgcgacaagctgaaaaatgctacatcaaatatgaattgaagcaaggatgtttccacatcaccgccagataatcgggagatgagtataaaatgcagtaaaattcacctccaaacaatcagagaatccaaaacgtttgattaaatttgcagaaatttttctttaatacaacttaatgatagagaagctgattgttcttgaggacattgatccggttattttttacggtgtaaacaacgccaacatacagttaattaaagctttatatccaaagctacgcatagttgcccgaggcaatgtcatcaaagtgctgggcgacgaggaagaaatgtgtgccttcgaggaaaatatcaccaaacttgaaaagtactgcgccgaatataattcactgaaagaagaagttatcattgacattataaaaggaaatgctccgcaagcggaacagacaggaaacgtgattgtgttcagcgtcacgggcaagcctatcatcccccgaagcgaaaaccagttgaaactggtagaaggattcgccaagaatgatatggtattcgccatcggtccggcaggttcgggaaaaacatacaccgctattgcccttgccgtgcgtgcattgaaaaacaaagaaatcaaaaaaatcattcttagccgccccgccgtagaagccggagaaaagctcggtttcctgcccggcgacatgaaagataagatcgatccatacctacaacctttatatgacgccttgcaggatatgatacctgccgccaagttaaaggaatacatggaattgaacattatccagattgccccgttagcctttatgcgcggacgtacgctgaatgatgcagtcgttatattggacgaagcccagaatactaccgcccaacaaatcaaaatgttcctcacccgtatggggatgaacaccaaaatgattgtgacgggagacatgacacagattgaccttcccgcttcacaaacatcgggattggtgcaagccctccgcatcttgaagggagtgaaagggatcagttttgttgaactgaataagaaagatatcgtacgccataaactggtggaacgtatcgtggatgcttacgaaaagttcgataaagaagcgaaattttaatatatatatcattatgaaagcattaacaaaaacagatttcaactttccgggacagaaaagtgtgtaccacggaaaagtgcgcgatgtgtacaacatcaacggcgaaaaactcgtcatggtagcaaccgaccgtatttcggcctttgacgtagtactacctgaaggtattccttacaaaggacaaatgctgaaccagattgcagctaaattcctcgatgccactactgacatctgtccgaactggaaaatggctactccggacccaatggtaacagtgggtgtgttgtgtgaaggttttccggtggaaatgattgtacgtggttacctgtgcggtagcgcatggcgggcttacaaaagcggtgtacgcgagatttgcggtgtgaaattgccggacggaatgcgcgaaaaccaaaaattccccgaaccgatcgtcactccgactacgaaagcagaaatgggattgcacgacgaagacatctctaaagaagaaatcctgaaacagggattggctactccggaagagtatgaaatcctcgaaaaatatacattagcccttttcaaacgcggtactgaaatcgcagcagaacgcggactgattctcgtagatacaaaatacgaattcggcaagcacaacggtactatctacctgatggatgaaatccacactccggattcaagccgttatttctatgctgaaggttatcaggaacgtttcgaaaaaggcgaaccacagaaacaactttctaaagagttcgttcgcgaatggttgatggaaaacggtttccagggcaaagacggtcagaaagtgcctgaaatgactccggctatcgtacaaagcatcagtgaccgttacatcgaattgttcgaaaacatcaccggtgagaagtttgtgaaagaagataccaccaacatcgctgaacgtatattcaaaaacgttgaaacgttcttgaatcgttgatagtcaacaaatgacagataataaatgatagttgacagataatgaatgacagttcgtatgcaattcatcgcatataacttcaaccttaattattatccgccaactatcatttatcaactatcatcttccaactatcatttatcaactatcaattaaaaagaatggactacccacaacaacatatcaagccttacgacgaagaaggaaaaaagaccgagcaagtggaacgaatgttcgacaacatcgcgcatgcatacgataagctgaaccataccttatctttaggtatcgaccgcagctggcgcaaaaaagcgattgcctggttacgccctttccaaccgcagcgtatgatggacgtagctaccggcacaggagattttgctatcctcgcctgccgtaaactgcaaccagccgaactgatcgggacggacatctcggaaggcatgatgaatgtgggacgtgaaaaagtaaaaaaggaaggactgtcggacaaaatctcttttgcccgggaggactgtacttcactctcttttgccgacaatgattttgacgccatcaccgtagctttcggtatccgcaatttcgaagacctcgacaaaggactctccgaaatgtgccgtgtattgaaaccgggcggtcatcttgtgattctggaacttaccactccggatcgtttcccgatgaaacaattgttttccatctactctaaagtcgtcattccattattgggcaaactgctctccaaagataacagtgcctaccgctatctgccggataccatcaaagtatttcctcaaggggaagtgatgaaaggagtcatcgcccgagccggatttagcgaagtcaacttcaaacggctgacctttggcatctgcacgctttataccgcaacaaaatagcaattcattgtgaatgattaatttaacccttattatattatggaaaaatatggtttaatcggctatcctctgcgacattcattttctatcggatactttaatgagaagttcaaatccgaaggaatcaatgcagagtatgtgaattttgagattcccagtatcaataacttcatggaagtgatcgaagagaatcccaacctgtgcgggctcaatgtcaccatcccttacaaagaacaagtgattccttttctggatgaactcgatcgtgacaccgcaaagataggcgcagtcaatgtgattaaaatcattcgccagccaaaaggaaaagtcaagttggtgggttacaactccgatatcattggattcactcaatccatccagcccttgttgcagcctcatcacaagaaagcgttgattttgggtaccggcggagcttccaaagctgtctaccacggtctgaagaatctaggtatcgaaagcatcttcgtatcgcgcacccacaaagccgacgatatgctgacttatgaagaactgactcccgaaattatggcagaatacacagtcattgtcaatagcactcccgtaggaatgtttcctaaggtagatttctgccctaatatcccttatgaacttctgacaccaaaccatttgctctacgatttgttatataatccgaacgttacgctgttcatgaaaaaaggagaagcgcaaggggctgttgtaaaaaacggtctggaaatgctcctgcttcaggcatttgccgcctgggagatatggcataaataagggttaaaagaagtttttatgaggagaaaagtagtatatagcatcattattatcatgctggcattgaccggctgcactatcggaggaagtttttatatgttaaacttctcattgactccgaatgccaaaattttgtctaaagatgctgactcttatcctttcatgtataaaaactacccttttttgcgtccatgggtggatagcctgagacaagtggatgcactgaaagacacttttatcataaacccacacggcatacaactacatgcgtattatgtggctgctccccaacctaccagcaagaccgcagtcattgtacacggatatacggataatgctatccgcatgtttatgatcggttatctgtataatcgtgatttaggatataatatattactccccgacctgcaacatcagggagaaagtgaaggtcctgccattcaaatgggctggaaagaccgtctagatgtattgcaatggatgaacatcgccaatgaaatctttggagacagcacgcaaatggttgtacacggaatttcaatgggaggtgccaccaccatgatggtatctggtgaggaacaaaagccatttgtcaaatgctttgtggaggattgcggctataccagcgtatgggacgaattctcacacgagttgaaaacaagttttcatcttcctccttttccactcatgtacaccacaagctggctttgcgaaaagaaatatggatggaatttcaaagaagcttcttcactgaaacaggtagccaaatcacaacttccgatgctgtttattcacggggacaaagacacgtatgtgcctacctggatggtatacccgctttacgaagccaaaccggagcccaaagaactatggattgtgccgggagccgctcatgctgtttcataccaagagaataaacaggagtacaccgaccgagtccgtgcattcgtcgggcgatacatccattaaacctattataacaaggagtttaagattcataacagaaaaagtttctatatttgcaagcataaaataatcgttatgaaatcaatattaacttttatactagctacttttcttctgttcccactacaagctcaagggaaagtatacacggtagacaaccttccgaaagtacatctgcaaaataaaatgcaatatgtttgcaacccggccggcatactttcacaggctgcttgtgacagtatagactccatgctttatgctttggaacaacaaactggaattgaaacagtggttgccgtagttccctcaatcggagaagaagattgtttcgacttctgtcatcagctgcttaataaatggggtgtaggaaaaaaaggcaaaaacaatggattagtcattttattagtcaccgatcaacgctgtatacagttctatactggttatggcttggaaggagtacttcccgatgctatctgcaaaaggattcaaacaaggtatatgattccttacctcaaagatgggaattgggatgcaggaatggtggctggtctaaaagcgacttgccagcggctcgacggttcgatggaaaatgatgctctctccgattctaacagcggtggttcttttgattttattcttgctattctttgttttatcaccattggcggaggtcttgctttcttttcggcacgcaaacaaagtcgctgtccgaattgtggtaaacatcaattgcagagaagcggaagcagagtcgtatcccggattaatggagtgaagaccgaagatgtcacctatacatgtagaaactgtggacataccatcatacgccgccagcaaagttatgacaatgattaccatcaccggggcggtggcggaggcggtccgttcattggtggttttggcggaggcagtttcggaggcggaggcggtttcggtggaggcagctttggcggaggaatgggcggaggcggtggtgccggttctcgtttctaaaataaatgttatccaatgccctagtttcgaaataaattagtaactttacctaatgactaagacagaagaaaatgaaagagaataaagaatatcaagaaaaaaaagaacaagaaaaagttgtccatgagccaactggttcttacggtatggacaccatcaccatgagacagaaaattatggaacgagttatgttaatggaagaaaatcagctcaaagaaatgcttcgattctccaacgaattggaacaaaaatcatggttattaccacatactcaagaagaattagagatcgcaatcaatagaggtatggaggatgtcaaggcaggaagaattgtttcacatgaggatgttctcaaatattatatgaaatgacaaatattgtttggactcaatcggctttgcaaacgctagaattagtttatttacaaacattacaatatacaaaaaacgaacgtatagctgctaaattacataataaacttatcaaagaagcagagatgcttagaactttcccaaatgcgggaaacattctaaatacttcagaaagagttacactctgttacagagcattagtagtagacactaattataaacttatttattacgttgatgctaataaggatgtaatcattgtgacagtttgggacgttcgtcaaaaccctgataaattaacaaaaactatagaataattagaaacatgaagaagtcaattattatcatcttagccgttgtggttatccttgttatatgggcagtaagtgtatataacggtctggttactatggacgagaatgtaagtggtcaatgggcaaatgtagaaactcaatatcaacgtcgtgccgacctgattcctaacttggtaaacacagtgaaaggatatgcgacacatgaaaaggaaacattggaaggagttgttgccgcacgtagccaggctactcaaatcaaagtagatgctgccgacctgacaccggaaaagctggcgcaataccaaaaggcacaaggtgctgtaacatcagcattgggcaagttattagccatcaccgagaattatccggacctgaaagctaaccagaacttcctggaacttcaagctcaactggaaggaacggaaaatcgtatcaatgtagcacgcaaaaacttcaatgatgctgcacaagcttataacaccaatatccgccgtttcccgaagaatatctttgcaggaatgttcggcttcgataagaaagcatattttgaagcagaagaaggaagcgagaaagctccgaaggtagaattctaaaaaagatttgatttacccaaaaagatacttgatatcatctgagatatttatctcggcattttttcattagataaaacacttctatattaagagttaaattcatagtaatgaaaactatgaatttaactcttaattttctattattcttctccttttcaatagaatatcccaaagtataaaagttaatgattaacatttactagtacctagttggctgtaccaaaaaaaagctgtacttttgcagccgtatacaaaataattctataactcatgagtaatcaacgatacatgatgcgtggagtaagcgcatcaaaagaagatgtgcacaacgccatcaagaacatcgacaaaggaatcttcccgaaagcattctgtaaaattattcccgatatattgggaggtgacccggaatattgcaacattatgcatgccgatggtgccggaaccaaatcatctcttgcttatatgtactggaaagaaacgggtgacttatccgtttggaaaggtattgcacaggatgcattgattatgaatatcgacgacctgctttgtgtaggtgccgtagacaatatccttgtttcatctaccattggacgtaacaaactgttgattcccggagaagtaatctccgccatcatcaacggaacagacgaattgctggccgaactccgtgaaatgggtgtaggcgtatatgcaaccggtggtgaaactgcagatgtcggcgatttggtacgtaccatcatcgttgactctaccgtaacttgccgtatgaaacgttcagacgttatcgacaatgccaatattcgcccgggtgacgtgatcgttgggttggcttcttacggacaagctacttacgaaaaagaatataatggcggtatgggtagcaacggtttgacgagtgcccgtcacgacgtattcggcaaatatcttgctgaaaaatatccggaaagctatgatgctgcagttcctgaagagttagtttattccggtaagttaaaactaacagacagcgtggaagattctccaattgatgcaggtaagttagtactctctcctacccgtacatacgcaccggtagtcaaaaaattgcttgatgcattgcgtccggaaatccacggaatggtacactgctccggtggtgcacaaactaaagttctgcattttgtagaaaacgttcgtgtagtaaaagataatcttttccctgttcctcttttattcaaaacgatccaagaacaaagcggtacggactgggcagaaatgtacaaggtattcaatatgggacatcgcctcgaagtctacctgtcaccggaacatgcagaagaagtaatagctatttccgagtcattcggtattccggcacagattgtaggacgtgttgaagcatgcgagcaaacagaattaatcattaagagcgaattcggagaatttagatattaaagaatggcagacaatagtaccatactagaaaaattagacggactcgtagcccgttttgaagaaatatctacccttatcacagacccggcagtgattgccgaccagaaacgttatgtcaagttgactaaagaatataaggaattagacgacttgatgaaagcaaggaaagaatatatccaattactgggtaatattgaagaagctaaaaatatccttgccaatgaatcggacgctgaaatgcgcgaaatggcgaaagaagaaatggacaatagtcaagagcgccttccggtattggaagaagaaatcaaactgatgcttgtccctgccgatccgcaagacagcaagaacgctattctcgaaatccgcggaggtgcaggaggcgacgaagcagctatctttgccggcgacctcttccgtatgtatgccaaattctgtgaaaccaaaggttggaaaatggaagtctccaatgcgaacgaagggacagccggtggattcaaagaaattgtttgtagtgtgacaggcgataatgtatacggaattttaaaatacgaatcgggagtacaccgcgtacagcgtgttcctgcgacggaaacgcaaggacgtgttcacacttcagccgcatccgtggccgtgcttcccgaagctgaagaattcgatgtagtcatcaacgaaggagaaatcaaatgggacactttccgaagcggcggtgccggcggacagaatgtaaacaaggtagaatccggagtacgtctgcgctatatctggaagaacccgaacaccggtattgccgaagaaattcttatcgaatgtaccgagacacgcgaccagccgaaaaacaaagagcgcgccttggcccgtctccgtacttttatctacgacaaagaacatcagaaatatatcgatgacattgcctccaaacgtaagacaatggtatctaccggagaccgttcagccaaaatacgaacttacaactatccccagggacgtatcaccgaccaccgcatcaactatacaatctataatctggcagccttcatggacggggatatccaggattgtatcgaccatctgatcgtagcggaaaatgcagaacgcctgaaagaaagcgaactttagagaagtggagagttgagaattgagagttgagaacggtttcttaaaatagtaaatagtaaattgcaaattgcaaaatagtaaataacaagatggataagcaacaattatttgaaaacataaagcgcaaaaaatcattcctttgtgtaggacttgatactgacatcaagaaaatcccggaacatctgttgaaagaagaagatccgatctttgcattcaacaaagcaatcattgacgcgacagctgatttgtgtatcgcctacaaacccaatctggctttctatgaaagcatgggtgtaaaaggatggatcgcatttgaaaagacagtaaaatatatcaaagataactatccggatcaattcatcatcgctgacgcaaagcgtggtgacatcggaaatacttctgcaatgtatgcccgcacattctttgaagaattggatatcgactctgtaacagtagccccctacatgggtgaagacagcgttactccgttccttacctacgaaggcaaatgggtgatcctgttggcattgacttccaacaaaggatctcatgacttccaattgacagaagacgtaaacggcgaacgtctgttcgagaaagtattacgcaaatcacaggaatgggctggcgatgaccgcatgatgtatgtggtaggtgctactcaaggacgtgcttttgaggacatccgcaagattgtcccgaaccatttccttctcgtaccaggcgtgggagcacaaggcggttcactcgaagaagtttgcaaatatggtatgaacagtacatgcggattgattgttaactcgtcgcgtggtattatctacgtagataaaacagagaaatttgcagaagctgcccgcaccgccgcacaagaagtgcaggctcaaatggctgaacaactcaaagcaattctctgaaaagggaaaaaggatctctaaagaaaacgaatgctttacgaaagaaagataattaacgaccccgtattcgggttcatcaatattccaaaggggttactgtacgatatagtacggcatccccttttgcagcgtcttacccgcatcaagcaagtaggattgtcatctgttgtgtaccccggtgcacaacacacccgcttccaacactccttaggtgcttttcacctgatgagtgaagctatcacccaactggcctccaaaggcaattttatttttgatagtgaagcggaagccgtgcaggctgccatcctgttgcatgatataggacacggccctttctcgcatgtactggaagacacaattgtaaaaggagtctcgcacgaagagatttctcttatgttgatggaacggatgaataaagagatgaacggccagctgagtcttgccattcaaatcttcaaggacgaatacccgaaacgctttctgcatcaactcgtaagcggtcagttggatatggaccggcttgattatcttcgccgcgacagcttttatacaggcgtaacggaaggtaacatcggctctgcccgaatcatcaaaatgcttgatgtagcggatgaccgtttggttgtcgaatccaaagggatctattctatcgagaatttcctcacggcacgtcgcctgatgtactggcaagtatacctgcataagacgtccgtggcatacgaaaagatgctgattagtactctattgcgtgccaaagaactggcttcacaaggagtggaactatttgcatcacccgcattacgttttttcctttacaatgatatcaatcctacggaattctataacaaccccgactgtctggagaattttatccagctggacgacaacgatatatggacagccttgaaagtgtggagcacccacaccgataaagtactttctactttaagcacgggaatgataaaccgaaatatctttaaagtggaaatttcgtcggaacctattagtgaggacagaaaaaaagaattaactttgcacatcagccagcaactaggcataaccctttccgaagcgaactattttgtctctacccccagcatcgaaaagaatatgtatgacccggcagatgacagtattgatattatctacaaagacggcactatcaaaaatattgccgaagcatcggacatgctgaacatctcattattgtccaaaaaggtaaagaaatactatctctgctatcagagattacacagataagtataaaatattcatgcaataacacggaaatctgaaaaaaaaatccgttatttgtgaactaattaaattttaaataaaagacatggagttctcggctaagcaaattgcagcatttatccaaggggaaatcattggagacgaaaacgctacggtacacacattcgctaaaattgaagagggaatgcccggagcaatttctttcctgtcaaatcccaaatatacaccttacatctacgaaacacaatcaagcattgtcttggttaataaggacttcactcccgaacacgaaattaaagctactcttatcaaagtagacaatgcatacgaaagtctagctaaattgctcaatctttatgagatgagcaagcctaagaaacaagggatagattcattagctttcgttgcacccagcgccaaaattggtgagaatgtatacatcggtgcttttgcctatatcggtgaaaataccgtgattggagataatactcaaatttacccccacactttcgttggagacggcgtgaagataggcaacagttgcctgctttactccaatgtaaatgtttatcatgactgccgcataggtaatgaatgtatccttcattcgggtgcagtgatcggagctgacggatttggttttgctcccactccgaacggatatgacaagattccgcaaatcggaattgttattctggaagataaagtagatataggtgctaatacgtgtgtagaccgtgctacaatgggagctacggtagtacacagcggtgtcaagttagacaatctgatacaaatagcacacaatgatgaaataggttcgcataccgttatggctgcgcaagccggaattgccggttctaccaaagtgggtgaatggtgtatgatcggtggtcaggtaggtattgcaggacatgctaaaataggagataaagttggattaggcgcacaatcaggtgtgccgggagacatcaagtccggtagccagcttatcggaactcctcctatggaactgaagcaatatttcaaatcatccattgcacaaagaagcctgccggatatgcagaaagaactgcgtaacttgcgcaaagaagtagaagaattaaaacaactattaaataagtaaataagtaaccaatgctgaaacaaaaaacgctgaaagatagcttttcactgagcgggaaaggtcttcacactggacttgatctcactgtaacattcaatccagctccggacaatcacggatataaaatccaacgcattgacgtagaaggacaaccaactattgacgcagtagccgacaatgtaacagaaaccacccgtggtactgtattgtcgaaaaatggagtcaaagtaagcaccattgaacatggtatggcagccctttacgcattgggcattgataactgcctgatccaagttaacggaccggaatttcctattttagatggtagtgcacaatattacgtacaagaaatagaacgtgtaggaacagtagaacaaaatgccgtcaaagacttttatattatcaagtctaaaattgagttccgggatgaaacgactggttcttctatcattgtactacctgacgagaatttcagtctgaatgtactggtttcttacgattcgactattatcccgaatcagtttgctacccttgaagatatgcataatttcaaagacgaagtggctgccagccgtactttcgtctttgttcgtgaaatagagccgttgctctccgccggattgattaaaggtggcgacctggacaatgcgatcgtaatctacgaacgcaagatgtcacaggaaagcttcgataagttggcagatgtgatgggagtacctcacatggatgccgatcagttaggctatatcaatcacaaaccgttagtttggcccaatgaatgtgcccgtcacaaactgcttgatgtcatcggtgacctcgctctaattggaaaaccgattaaaggtcgtatcatcgctacccgtccgggacacaccatcaacaataaatttgcccgtcagatgcggaaagaaatccgtctgcacgaaatacaggcaccaagttacgactgtaaccgtgaaccaataatggatgtaaaccgtatccgcgaattgttaccgcaccgctatcctttccaactggtggacaaagtgattgaaattggtgccaactacattgtaggtattaaaaatatcacagccaacgaacctttcttccagggacattttccacaggagcccgttatgccgggagtacttcaagtggaagcaatggcacaagtcggaggcttgctcgtcttgaattccgtagatgatcctgaacgttattctacctatttcatgaaaatagatggagtgaaattccgtcagaaagtagtgccgggagatacaatcatctttcgtgtagaactgctggcacctatccgccgtggcatttctaccatgaaaggatatgcgtttgtcggcgagaaagttgtttgcgaagcagaattcatggcacaaatagtaaaaaataagtaataattgatatttaaaagcatgataagtcctttagcgtatatccatcccgaagctaagatcggagaaaatgtagaaattgcgccttttgtatttatagataagaacgtagttatcggcgacaacaataaaattatggctaacgccaatattttatacggttcacgtattggtaacggaaacacgatttttccgggtgccgttatcggagccattccgcaggacctcaagtttcgcggtgaagaatcgacagccgaaatcggagataataatctgattcgtgaaaatgtaacaatcaaccgtggtacggcagctaaagggcgcacgattgtgggaaataacaatttattgatggaaggtgtacacgtagcacacgacgcattggttggtaacggatgtatcatcggtaactctaccaagatggcaggcgaaatcgtcattgatgataacgcgattgtcagcgccaatgtattgatgcatcaattttgtcatgtaggcagtcatgtaatgattcagggcggatgccgtttcagtaaagatattcctccttacatcattgcaggacgcgaaccgatcgctttcagcggaatcaacatcatcggcttgcgccgtcgtggcttctccaatgaagtgatcgaaagtattcacaatgcatatcgtatcatctaccaaagtggtttgaacacgacagaagcattgaaaaaaatagaagatgaattcgaaaagagtccggaaattgactatatagtcaattttatccgtaattcagaacgtggtattattaaataaacagttcaaaatagtcatattatgatatacagatttactatcatatctgatgaagttgacgattttgtcagagaaatacaaattgatccggaagcaactttttatgacttccatgaagcaatactgaaatcagtagggtacgcaaacgaccagatgacttctttctttatctgcgatgacgactgggaaaaaggaaaagaagtaaccttagaagaaatggacgacaatccggaaatagatagctgggtaatgaaagacactgctatcagtgaactggtagaagacgaaaaacagaaactgctatatgtattcgattacataacagaacgttgtttcttcatcgaactatccgaaattatcaccggaaaagatatgaatggtgccaaatgtaccaagaaatcaggagatgctcccaaacaaacggtagactttgaagaaatgaccgctaccggaggttctcttgatctggatgaaaacttctatggagaccaggacttcgacatggaagacttcgatcaggaaggatttgacataggtggtgacactagcagcccatacgaagaagaaaaattctaagtattaagcatcaagtattaggtattaattgctatgtagtgtcaggcagttaatacctaatatttttttttagtcccgtacgctttaatacttaatacttctatacttaatacttaaaaatctatgcctactctcattgttcttataggtcctacaggtgtggggaaaacggagttgagcctgcgcttggcagaaacatttcagacaagcattgtatctgccgattcgagacagctttatgccgaattaaaaataggcacggcagctcctactcccgaccaactcaaacgtgtcccccatcaactggtcggcacgctccacctcacagactattacagcgctgcccaatacgaaacagaagcactggaaattctggagaaattattcacgcaacacgaagtcgtgattctcactggtggctcaatgatgtatgtagacgctatctgtaagggaattgacgatattcctaccgttgatgcggaaacccgtcaactcatgctacaaaagtatgaagaggaaggccttgaacaactctgcgcagaacttcgcttgttagacccggaatattaccggattgtagatctgaagaatcccaagcgggtaattcatgcgttggagatttgctatatgaccggacgcacttatacttcttttcgcacccaacaaaaaaaacagcgtcctttccgtattctgaaaatcggcctgactcgtgatcgggaagaactttatgaccgtatcaaccgtcgggtagaccagatgatggaggaaggattattggaagaagtacgttccgtacttccctatcgtcacctcaattcactcaatacagtaggctataaagaactgttcaaatatctggacggagaatgggaactctcctttgctatagacaaaatcaagcaaaactcccgcatttattcgcgtaaacagatgacctggttcaaaagagatgaagaaataaaatggttccacccggaacaagaaacggagatactagcgtacctccgtcaatctttataacattatattttgacaatatttagaaacagaagacatctaaaatctactgctattcttcagatgtagttacttttattgttgaagtcactgtatcattaatagcacgaatagaaatttgacgggcttgatattcttctttcactaatagatttacttcaatcactccattctttcccttatcaccataagcagccaatgcagtcttatctttcaatacagatatactcctaatacgatcaggagaaatattcgctaaaggatcatcacctgtagcctctttgccatcaattataaccaaaggtttacctccatcagcagaacgaaacgtagctccccaactctttgccccactatttaatgcatccaaccttgttttattaatgccttcgatttcaatctttctcggcgcaaactttttttccgaatatagttttatatccatcactccatccttagccttttctccataaatcttaatagctttttcaggacctatgacagacacactttcaatacgttcaggattcaaagcatttactacttcacgttcagactctttcccattaataataaccaaaggttttccttcaccggaaattccttgtaccgaaatagccaccttctttttcccggatgttaagacagaatcttttttttctgtacgataacctaccactactaccttattcttggtagtatcaataggctccttaacaacattttcttcactctttttttccacaatttccgccaaatcattaactttgactgcagaaatctcttccactttttcagagatttcaggacgggcaaaagcagttactgcaatagctgccaacggaagtacatacaggtacttcaaccgtgcccacggattcgatttttcttttaacatcatagtgatacgttttttaagtttactgtgattaaagctgttggccatagagtagagccttgtgccaacggctttttttattaataatagttgatattctttcgcgtttacaccctcattaatgacggtctcgtccgcttcatattcgtgaacgttctgcaactcctgtttcaacaaccatgcaccaggattgaaccattggaaaaagatgcaaatatccgccaccaataaatctactgaatgacgatggtggatatgagccatttcatgaataaggatttccctcccgttttcctccaggtctttccggctgatgacaatatacttcatccaactgaacggagctatctcctgattgtgcaccacaagtgtaactcctttctccaacttctcatgtttgccggaatgtatcaaccggaagagacaaatcaaagaatagatattgcgacaggcaagaaacagaatacccgccagatagaccaacagaacaatctgtacccaagatatggccggcgtctcctgcactgcaccgacattggcaggagtagcctccaactctgccatcaatagcaattgttcaatggaaagcacagcctgctgcacttcaacctgatgccgggtagttacttcgatacaaggaatgagtaatgaaaagaacaacactcccaataaagccatacgattgaaacgatgaaaggtttccttgctaagtaataaccggaaaaacaggtaaaacagaacaagacaaacagatgattttaatatataaatgaagaaaactcccatagcatagattttcgtttaatagattagtgttttttgtcagcctgttccacttcctcgatgagctgtttcaattcatccaaggaaatatcttcctccttaaccaaagaagaaacggcattcaggtaagaattattaaaatacttactaatcacattccgcagcgttcctttacgaaaatcttcttcactgactacgggataatattgataggtatttccgaaagtataatgagctagaaaacctttttcttccaacccacgcacaatcgtagatagtgtattgaaatgtggcttgggatcttcatagaaagccaacatttccttcacgaacaagggacctttttcccagaaaaagcccatgatttcttcttcttttgctgttaatcctttcatatctgcaactttgtttgctgcaaataacgaaaagttttagttcataaactaatttatctagttaaagtaaactaaaaactatagttaagacgaagaatctactattaaacacctgtgaaacagatttattacatctcttttagctccacagtttattgacaataaagttgccgataaagaataagtcgcccataaaaataatgctaaataccagaaaagtgaaacaagtactccaccgggctcctccctcctcttcgccacgtttgatacgaagcagggaactatgtaaacaatcacctgctatgaatagtacaaacaaactcggtatcaagtcaccccatgacaccaaccacagattatcacccttccccatcaggaacgtcaatgccacggccaataagaagacagaagcatattgcaagtcttttctttttgaattcatagtggtaatgtttaaagtccttttcacaaagatattgaatctcacccaataatccttatcaaatctatataaaaatcggtcaggctttgttgaatctaagtttattgttacttttgcaagtacgaattaaaaccaaaaccgattataaacgcagatgaaaaagatcagcatcactttattactctgccttctctgtctgaccggaatggcacaaggacaaaaggcactcgatttaaaagatattacctccagacgtttccgcccggaaaatattcagggagtaatccctatgcctgatggcgaacactacacacagatgaacgctgacggcacgcaaatcattaaatactctttcaagacaggcgagaaagtagaagtgattttcgatgtaaataccacacgcgaatgtgacttcaagaacttcgacagttaccaattctcgcccgacggtcagaaattgctgattgctactaaaacaacacctatttacaggcattcatacacagctgtacattacatttaccctttgaaacgaaatgataagggcgttacgacaaacaacattattgaacggctgtctgacggtggacctcaacaggtccccgtcttttctccggacggtaccatgattgcatttgtacgcaacaataacatatttcttgttaagttgctttacggcaacagcgaaagccaggtcacagaagatggcaaacagaattcggtaatcaacggtattcctgactgggtgtatgaagaagagttcggcttcgaccgtgctttggaattcagcgccgacaatacgctgattgcttttatccgtttcgacgagtcggaagttccctcctactctttcccggtatttgccggacaagcaccccgcattgatgctttaaaagattatccgggcgaatatacatacaagtatccgaaagccggatatccgaattcgaaagtagaggtacgcacgtatgacatcaaatcacatgtcacccgtacaatgaaactcccattggatgcagacggatacattccgcgtatccgtttcacaaaggatgccaataaactggctatcatgacattgaaccgccatcaagaccgttttgatctttactttgccgatcctcgttccacactttgcaaacttatacttcgtgatgagtctccttattacataaaggagaatattttcgataatatccagttctatccggaatatttcagcctgcttagcgaacgtgacggttacagtcacctctattggtatagcatgggaggtaatctgattaaaaaagttactaacggtaagtttgaggtgaaagattttctgggatatgatgaagaagacggttctttctattacaccagcaatgaagaaagccctctgcgcaaagctgtctataaaatagacaagaaaggcaagaagctcaaactatcccaacaggtaggaaccaatacaccgctcttcagcaaatcaatgaagtattacatgaacaagttctccaacttgaatactccgatgctggttacactgaatgataattcgggcaaaacactcaaaacgcttattaccaatgacggtttgaaacaaacattgtccggatatgctgtgccacaaaaagaattcttcactttccaaaccacagatggcgtgaagttgaacggctggatgatgaaaccggttaatttttccgcatctaaaaaatatccggtactgatgtatcaatatagcggtccgggctctcaacaggtattggatacctggggaatcagttgggagacatacatggcaagccttggttatatcgtggtatgcgtggacggtcgcggcacaggaggtcgtggagaagctttcgagaaatgcacttatctgaaaatcggagtcaaagaagccaaagatcaggtagagactgccttgtatctcggcaaacagccatacgtggataaagatcgcatcggtatctggggctggagctacggcggatacatgactcttatgagcatgagcgaaggaactcccgtattcaaagcaggagtagcagtagctgcacccaccgactggcgtttctatgatacgatttacaccgaacgcttcatgcgtactccgaaagagaacgcggaaggatataaggaatcatcagccttcacccgtgctgacaaactgcatggaaacttgttgttggtgcatggcatggcagatgacaatgtgcacttccaaaactgtgcagaatatgccgaacaattggttcaacttggaaaacaatttgatatgcaagtgtacacgaaccgcaatcatggaatatacggtggcaatacccgccaacacctatacacacggttgaccaactttttcttgaataacttataatgacggacagagtacgtaagcccgaatggctgaaaattaatatcggtgccaacgaacgatacaccgaaaccaaacggattgtcgactcccactgcttgcatactatatgcagcagtgggcgttgccctaatatgggggaatgctggggaaaaggaactgccacctttatgatcggtggtgacatctgtacgcgcagttgcaaattctgcaacacacaaaccggccgcccgcacccgctagacataaacgaacctacccatgtagcagaatccatcgcactgatgaaactggatcatgctgtcatcacatccgtagaccgggatgatctgccggatttgggagcagcacattgggcacgtaccattcaagaaataaaacggctgaatccacaaacaacaatcgaagtgctcatccctgattttcaaggcaggatggagttgttagatttggtaatcgaagcccgccccgacattatttcacacaatatggaaaccgtacgccgcattagtccgctagtgcgcagcgcggcaaattatgatacaagtttgcaagttatcagacacatttccagaaagggagttaaatctaaaagcggcattatggtcggactgggtgagaccccggaggaagttgaaacattgatggatgatctgttagcaaccggttgccagattcttaccataggccaataccttcaaccgactcaccggcattatcccgttgcggcatatatcactccgcagcaatttgcagaatataaaactgtaggtttagagaaaggattcaacatcgtagaaagcgctccccttgttcgttcctcctaccatgcagagaaacatattcgttagtaaacaaaacacataccctatttgttttatagatagaaccgacaaataaacataaatatagagatggctcataaaggaatactttcttccgcatttaacatgtcgctgggttttatccccgttattatttccattttattgtgtgaacttataacgcaagacacggctatttacatcggtacaggcataggtattataggtatatacctttcttatcgacgtaaaggattgttaattcctaattttatcctctatatagcgaccggagtgttagcactattatccgtagcagctctcattcctggtgattatgttccccccggtgcgcttccacttacgctggaagtcagtattctcattccgatgctaagtctttatatgcataagaaaaggtttatcaaccacttcttaaaacagataggttcttgcaacaaacgtttatatgcgcagggagcagaggcagccgttgtctctgcccgcattgccttgattttcggaatactgcattttattataatcagcatcaccgtcattttccaaaacccactaagtaagacaagtctgtttgtactctataaagtgttacctcctactgtctttctgatgagtatcctgttcaatcagatcgccatccgtttcttcaatcatttaatgtcacacacggaatatgttcctattgtgaataccaaaggagacgtgatcgggaaaacacctgcaatagaagctgttaattacaaaaatgcatacatcaatccggtgataagaattgccatatccactcacggaatgttattcctttgcgacaggccatcaacagccattctggatagagggaaagtagatattcccatggaatgttatcttcgctacggagaatctctggaagtaggcgccactcgcttaatcaacaatgcttttcctcatgaaaaaggtatcaaacctgaattcaatatcgtttatcacttcgagaatgaagtgaccaaccgtcttatctatctattcattgtcgatatcaaagacgattccatcctttgtactccccgctttaaaaacagtaagctgtggagtttcaaacagatagaggagaacttaggaaaaggcttcttcagcagttgcttcgaagatgaatatgaacacctgaaaggcgttatttatataagagaaaaatacagggaatcttagataaatcgggcacgtgtcctttccagtccttcactgtacgcgtctgtatatattctccttcacaagtaatattggcagcgatacagagctttgtttgaggacggcaattcaacaaaatatcttctaccatcttatgatttcggtaaggcgtctcaatgaaaagttgcgtttgattttcagcatacacacgctgctccagtgcttttagtttcttggcacgttctcccggttcaatcggcagataaccgtgaaacgcaaaactctgcccgttaaagccggaagccatcacggaaaggataatggaagaaggtccgaccaaaggaaccactttcagctttttacgttgtgcgatagcaaccacatccgctcccgggtcagctactgccggacaacctgcttcggagataacccccattgaagctccacccaccaaaggttgcagataaccggaaatatcatcaggagaagtatgcttgttcaacgggtaaaatgtcaatgcatcaatatcaatctcccggtccacctttttcaggaaacgccgggcagaacgaacatcttcgactataaaataccggataccagaaatgatctccttattataagaaggcaataccttttcaatagacgtatcacctaacgtcacaggcaacaaatagagggcagtttccacttttaaaattgagaattaagactatactttaatattaaaaatcaaataaggttttgagcgaagctaattaaaaattgaaaaatgcaacagtttaggaagccagatagttggattcacttaacatcacatgataatcagtaaattccaggagatctttcagtttcatgtccttatgctttttcatataagaggcgatgattcttgcacccatccatgttccgatcaatgccggagcttgagcacccaacatatcgacagcaggagcaggcttcatataatagcggatcaccatcgggtctcgtgcatgcagatgatcgttggtacagatataattccatatctccttttcattctccttacaccagtcgttttcctccttggaatatcccatcgcttcgccgatatcactatatcctaataagttctgcacgacgtagttgatttttccggagtgcatcatcaagtcaatcaaacaagtaccctcatgatagttcattccgtaacggctcaaaagataaaaagcaaaacaatccggcacaatccgttccggacgcatcgagcgacattgataatcgtaatagaaacgcttataaagaggataatcttcccccatatatttatcaagactgattcccaataaagaatccactaaaataatagattcgttgaaagcggatacttgcgaatagataaacggcactttcgtatcaggcacttcctttttcagtttccgaaatcctttgctaagtcctttttccacttcatccagattaggatattttgcttctacatcgctaagcaaacgaaccaaagtcgtatccgaatagaatttttgcagacgttgcgagatggtatcatctttcactgtaccgatagacaatacatcctcaatcaggattttcgtcggcatacggtagtccatcgtcaacttctgcatagcagaaaaactgttggagcgaacatattcgctcaacagcttatcatatctcagaacagaaatctcttcttccttctgctccgtaccctttcctgtgcttatcccgcaggaggcgaaaagcatactcattaaaataataagaagagagatccgtagtttcatatttttttatccgtaaatgatgttaccattttcgtccatatactcatcgagtcctttctcgtaagtagccatggcacgaagactcatacctacactggagaatccaccgtcatggaataagttctgcatagttaccttacgggtaagatcggagaacatcacgatgcaataatcggcacattcgtcagccgtagcatttccgagaggagacatacggttggagaaatcaaacagtttatccatacccttcacgcccgaaccggcagtagtaaatgtaggagactgcgagatagtattcacacgtacgctatgttcgcgtccgtagatgtaaccaaagctacgtgcaatagattccagcaatgcctttgcatctgccatatcattgtagccgtagaaagtacgctgcgcggccacgtagctcaaagcaacgatagaaccgtaatcagcaatagcgttcaatttcttggccgactgaatcattttatggaatgaaacagctgaaatatccaatgtcttatccaacattccatagtcaaggtcatcgtaagtacgttttttgcgcacgttgggagacataccgatagagtggagtacaaaatcaatttgtccacccagtatatccatggaggtcttgaatacattttgcaaatcttctacactggtggcatctgccggaataacctggcaatttaatttctgggccaaagcgtcgacttctcccatacggatagccatcggagtatttgataatgtaatagttgcaccttcttctacggcacgctctgctactttccaggcaatagactgatcgttcaaagcaccgaagataatacctctttttcctttcaacaagttataactcatatcttttaatagttaaattttgtgcaaagataggaactttctgcataaaaacacgagaagtgtgcaaataatagacagaaatgacaaaaaatacacgtattctatcaattagtccacatcctcttggggtttgccacctatctttgcaatcgataattaagaggttttttcataatatttatttaaggttagaattaggttaacatgaatttgtcttattcctctcctgcaggctgcctgcgacagatcgcctgcggaaggacataagaattatgaaatcgccctcattaatcatcacccaattaccaagaaaaacaatagatgtataaccctatagaaataagttactaaatgaacacattgacaaaaagactcttctggatggccctatgctgtttaccgtttatctcatcaggatgtaaacaaagcgagactaccgtaaaagaaagctccatcagtgacgctctttaccagaatttaccttttgaaatgccgaaagtacagcaaccggttttccctgcttacgaagtaaacattgagaaattcggagccaaaggagacggtctgttcctgaataccaaagctatcaacgatgctattaaagacgtgaatcaacgcggagggggtaaagtgattatcccggaaggtgtctggttgactggtccgatcgagctgttgagcaatgtaaatctatatacggaacaaaatgcgctggtactttttaccggtgattttgaagcatatcctatcattgccacttctttcgaaggactcgagactcgtcgttgccaatcaccgatttcagtacgcaatgcagaaaatatagctatcaccggacatggtacatttgacggaaacggtgactgctggcgtccggtaaaaaaaggaaagctgactgcttcacaatggaaaaagctggtaaactcgggaggtgttctcgacgagaaacaagagatatggtatcccactgccggctcactgagaggtgcaatggcttgcaaagacttcaatgtccccgaaggtatcaacacagatgaagaatgggctgaaatccgtccatggttacgtccggtgttgttaagcatcgtcaaaagcaagaaggtgctgttggaaggagttactttcaaaaactcaccaagctggtgtctgcacccattgtcttgcgaagatttcacagtaaataatatcatggtcatcaacccctggtattctcaaaacggtgatgctatcgacttggaatcttgtaaaaacgctctaattatcaatagtgtgtttgatgcgggagatgatgccatctgtatcaaatccggtaaagacgaagatggacgccgtcgtggagaaccttgccagaacgttatcgtgaaaaacaatacagtattgcacggacatggcggattcgtggtaggtagtgaaatgtccggcggtgtgaagaatatctatgtagaggactgcacatttatgggtacagatgtaggtttacgtttcaagagtacccgcggacgtggcggtgtggtagaaaacatctacattaacaatatcaatatgattaatattccgaatgaacccttattgttcgacttgttctacggtggaaaaggtgccggtgaagaatcggaagaagatctgttgagccgtatgaaaactgccattcctccggtgacagaagaaacaccagctttccgcaatattcatatttccaatattgtttgcagaggttcgggacgtgccatgttcttcaacggactgccggaaatgcccatcagcaatattaccgttaaaaacgttgtgatgacggaagctgcggatggagttgttatcagtcaggtagacggagttactttggaaaatatttatgtagaatcttctaaaggtaacaatatattaaacgttaagaatgccaagaatctgactatagacggaaaggtatatgaggaattaggtgcaaaagaggagattttaagtctcaaataaaaaactcattgccattctgtgatgcaaaatagaaaccacaatatcattatatagagtaaaaagctcaaatagcagactataatctcctcaaaagagacacagtctgctattttttctgctatttttgcaaggagaaatacgacgtataatttcagccttagaaacatgaagaagaatctttttattattactttctttttaggagctttcagcctgtctgcccaaacgcagaaacaggagaaaaccatcacagttgaagtacaaaacaactggaatcagcccaaagcggatgctccggttgttatcaatctacatgagttgcacgctggtttcaaagtaaaatcagccgttgtcatggaaggaaggaaggaaattccttcgcagttggacgatttgaaccgggaccgcaagatggacgaactggtctttgttgccgatcttcctgcccatggtagaaaaacatttcaggttacactttcttcggaaaagagtacaaagacttatcctgaacgagtttatgccgatatgtttattgtagacaacaagaaaggtaaacatcaacgggtacaggctatcaccgttcccggcactagcaatatatacagcatggtacgtcctcacggtccggttttggaatcggaactggtaggataccgtctttatttcaatgaaaaacagacaccggatatttacggcaagttcaacaaaggactggaaatcaaagaatcgcagttctatccgacggatgagcagttagctaaaggattcggagatgacgtacttcgcgtgttcgacagttgcggaccgggtgcattgaaaggttgggacggacaaaaggcaacccatattactccagtggacactcgtacagaacgtatcgtctcttatggaccggtacgtgtaattgcagaaatagaagtaaccggatggaaatatcaggaccaggaactgaatatgatgacacgctacacgctttatgccggacatcgcgatcttcatatcgaagcattctttgacgaaccgctcgataaagaaattttctgcacaggtgtgcaagacatcgtaggtacttccaaatctttctccgatcataaaggactcgtaggaagttggggaacggactggccggtaaacgataccgtaaaatatgctaaagaaactgtagggctgggcacttgtattccccaacgttatgtaaaatcggaagaaaaggataaagccaacttcctttatacaattaccgccccgggaaataaatatttccagtatcacacgactttcacctcgatgaaagagacattcggatataaaacgccggaagcatggtttgctcatctccgcgaatggaaagaagagctggctcatccggtgacagtgagaataaaagataaccgccccaataaatagggtagaaacaaatacaactaaacaaaaattacgaggtatctaccaatttttctatgactctgcacaaatattcctccttgtgcagagtctttttatttacctttgccatcagataaaaccaacgaatcatatctataaataatctatctataacatgaaacgattgacacagactttagccttttgcttattaacggttttcaccgcagtagcacagaagaactatgtatctgaagtatgggtttccgacctcggaaacggtaaatacaaaaatccggtgctttatgccgactattccgatccggatgcttgccgtgtaggagatgatttctatatgacttcatccagtttcaactgtttgccgggattgcaaatccttcattctaaagatttagtcaactggacaatcatcggtgccgcagttcccaatgccctctcccctatcgaaactccggaacggccggaacacggcaatcgcgtatgggctccggctattcgtcattacaacggtgagttttacatcttttggggagatcccgatcagggagcttttatggtgaaagccaaagatccgaaaggtccgtggagcgaaccggtcttggtgaaagcgggaaaaggtatcattgacacttgcccgttctgggatgaagacggaaaagtatatatggtacacgcatacgcaggaagtcgtgccggactgaaaagtgtaatcactatctgcgaactgaatgcagaagcaacaaaagcgatcactccttcccgtataattttcgacggtcacgaagcacatcagacttgcgaaggtcctaaaatgtacaagagaaacgactattattatatcttccatccggccggcggtgtgccgacaggctggcaggtcgtattacgttctaaaaacatctacggtccttacgaatggaaaacagtacttgcgcaaggtaactctcctgtcaacggtcctcaccaaggtgcatgggtagatactcctaccggagaagactggttcctccactttcaagatgtcggtgcttacggacgcattatgcatctccaaccgatgaaatgggtgaacgactggcctattatcggtattgataaagacggtgacggctgcggagaacctgttttgacttacaagaagccaaatgtcggtaaaacatatcctatctgcactccacaagaaagtgacgaatttgatgggtatacactttctccgcagtggcaatggcatgctaacattaatgaaaaatgggcgtattatgcaggtgacaaaagctatgtcagattatactcttatccggtagtagaagattataagaacctgtgggatgtagccaacctcttattacaaaaaactccttctgataattttaccgcaacaatgaaactgacgttcagccctaaccaaaagaataaaggcgaacgcactggacttgtcgttatgggcagggattatgccggacttgttctagaaaatacagacaaaggtttggttctgtcgcaagttgaatgtgacagagcagataaaggcaaaccagaagaagtgaaagccgctgttgatctttcgcaaaacacggtttatctgaaagtgcgtttcagttgtgacggaaagaaaatcaagggtagtgaaggcggacatgacctcattgtgatgtgtaatttcagctatagcctcgacggaaagaaatatgaatcattaggtgttcctttccaggcaagagaaggacaatggattggtgccaaagtcggtatgttctgtacgcgtccggctattaaaacgaatgacggcggttgggcagacgttgactggttccgtattacgaagaagtaatcaaagtatatataaggatgaaaaaagattgtcccacaactttcaagcagtagcgggacaatcttttttatcttctttaaacttacatacaagcccagccaaatttacgaacaagctctgcaagcagactacggtcttttattggcaaattaatgaccacattctcgcgcttctctccagataaaacatatccctcagccggcaatttatcttccaacaatacactttcctttaataacgttttctggtattcacccgattgaaacacaacatcgtaatactcatgttcattttcaggctgtagatagagtaaacgcaaatcggctttacctgctaagaaggattcaagtctacgtgtagagatacgtattcccgtatagcgataaaccgtctcatcatcatataaaagacaaagatacagtgtatcaaaggcatctcttgccacaaaaagctgaggcacatcacagaaatccagaattttgtctatccttaacacatcttccattcccataatcagactattttagcttgtaaaacattaaaatcctttgttctccaccaagaataatgtgctatatcaaatgttttctttaacactccatcttttggttccaatatgactaaagcaatatttgccttcttgaacttaggaagctttaatcttttctccgcttcttccctctctgaaaatagagagactgcccttgtcacacattcatctattcctaatcctttaaagaccttatccggctgcatttttctttgcgaaaagaaatcttctgttgtaacaggattaccatttgcaattctataataacagccttcgcaccgcttcgcatctgttgggggacattgttcaggcaatgcctcaaaccattctgcattcattattctttagtttttcgcaaagttaagccaatctggtagaataacaaatatatttccggctttgttgttcattcgatattctctaaactattgcctcattcttcccaatctcatttttttagtatacctttgcagaataaaagatttaaatatagaattaactataaacataagccttaatgaaaaaactaataatattcgatttggacggtacattattaaatactatcgcagacctcgcccatagcactaattatgctttgaataaattaggataccccacacacgatgtagaaaagtataacttcatggtaggaaatggtatcaacaaactctttgaacgtgcattacccgaaggagaaaagacagaagagaatgtgctccgggtaagaaaagagtttattccttattatgatattcacaatgcagacgatagtcgtccttacccgggtatttcagcgttattgtcttatctgcaatccgcaggcattcagattgccgtagcctccaacaaatatcaggccgctaccgagaaactggttgcccactactttccggaaattcatttcactgccgttttcggccaacgggaaggagtaaatgtcaaacctgatccaacaatcgtttttgatatattaaaacttgccgatgtacgaaaagaagatgttctttatgtaggtgattccggtgtagacatgcaaacagcagccaatgccggtgtaaccgcttgcggagtgacatggggattccgaccacgcacggaactagaagaatttaatccggcatatatgacagatgtggccgaaaaaataaaaaaaatggtcttttaacgatgatatccttacaagaataattatgattcggcaagtaaaacttcaatagtctcaataagttctcttgccggagcttttatcgtactgatttcatcctccgatattgaataaatgcaattataatcccctttttgccgtaattgttccatacgcgccaaaaaacttcccaaacgtgcactaattttgcctgtttttataaaattcaagccaaagcaagctatcaacccatcatgggttttacatgataatccattttgtattaataaagcctgaacagcatgaaaacaggcataataatatctattggaagcaatatcccaatacttcagatcaaacatctcatctgcttgtttcaaaaatactttagctttctccaactgtaatatcaccaaagaattacgttcttcatctgtcaatttcatactaattcaattccttcctgctctacatttttataaaatggtgtaatacaacttgcagcccattctttcatcgtatacataatcggattaattcgcgctcccaagtcccatcccaacatagttaagggaaagcttaccttatcataatcttcaggctccaatttttctttatctaagataatcaaaatatcccaatcagaatcaatccgtgcatccccacgagcttgagaaccaaacaacaaagccttgccaccttttggtaaatgctctgtcaatgcctgcttaatagactctaatattttatttgtatgacttttcatattcgtctccccttactcttctacaaatatacaataaatatcaatacaacaatatgacttacaaaaaaatcgctcttgctaattattcatacttggttcttatccatgactaatatgaataaagaataaagtctaatattacatattttccgtacaaatttcaatatcactttccttacaatgcattttctttgcaacaggtaaagaaaggctcacctttgcgtgcctaaatctaagaacaatagtaatctaatttattataaaatgaaaaagcatcttatactattttttgcaggagtaatattgagttacgggaacataaaagcacagacagttcccgataaaaaagaaattctgaaagtaactcttcatgtgaacgactatttcatgaagaaatatgccgactatcgcactccttcctttgtgaaaaaagtagttcgccccagtaatatctggacacgaagcgtatattacgaaggcttaatggcactctactccatctatcccgcagacgaatattatctctatgccaaagaatgggcggattaccaccaatggggcttccaccgtgggacaaccacccgtaatgcagataattactgcgccagccaaatctatctcgatttatacaacatttgccccgatcctgaaaaaatacggaaaacgaaagccaatatggatatgctggtcaatactccacaaataaacgactggtggtggatagatgctatccagatggggatgcctatatttgccaaaatggggaaacttacaggcgaacagaagtacttcgacaaaatgtgggatatgtacgaatatacccgtaataaacacggagagaacggaatgttcaatgtcaaagaaggtttgtggtggagagaccataatttcgatcctccatacaaagagcctaatggcgaaaactgttattggagccgtggtaacggatgggtatacgcagctttggtgcgggtaatgaacgaaattccatctgatgaaaaacatcgccaagattacatcaatgattttatggctatgagcaaagcactgaaacaatgccagcgtgaagatggcttttggaatgtcagcctccacgatccgtcaaacttcggaggcaaagagacttccggcacagctcttttcgtatatggtatggcttggggcgtacgcaacggtctattggataaaaagacctatctgcctgtaatcataaaagcatggaatgctatggtgaaggatgcagttcacccgaatggttttcttggttatgtacagggaaccggcaaagaaccgaaagacagtcaacctgtcacatacgacaaagttcctgattttgaggatttcggaacaggatgtttccttcttgccggaagtgaaatctataaattagacctcaatatgtaactgataaacatacttatcttgaatccggtctatccttcacaaaccggattcaaggtaagtatatactacgttttacttctctcccctttctggtaagccgaaggagatactccaaactgcgctttaaaacatttactgaaataaagaggatcgttaatacccactttataagaaacttccgcaacagtcagatccctttcggtcaaaaacagttcggcagccttcttcattcgtacgacacgcaaatactcattcggtgagtatcctgtcactccgcgtaatttcttataaaacacagttcgtcccatccccatcatctgcgcaaattcatcaatagaaatgttgtattgagaataaatcttttccaccacagccaccaactgatctgcaaactccttatcccggtccgtgttacataaagcaggacgcactacccccggttcactggaaaacttcttccgtaacttttcgcattgctctatcagccggaacacctgcgcaagcaaaagcttaaaactaaatggctttgcaacataaacatccgctcccgcttcaagtccttccaggtgcttatccggtgaagtcaaggcagtcagcagaataataggaatatgacttgtcgcaaattcagttttcagtttctttgtcacttcgaaaccggtcatcccaggcatcaatacatcgcagataatcaagtctgcgtcatagttgcatgccttttcaaatccggatattccatccgcagccacttctacttcaaaataagcactaagctcctcctgcaggaacccacgaatatcattatcgtcttcgatgactaatattttatgttttcttgatgtggtgactgtcttttcatgttcctgacattcctctgaaagctcctgcaaatggtgagtctgcatattcgcttcttccaacaggagattgccgggaaccaggaagtctttttccgaataaacagttttatcagtcggaatacataccgtaaatacggaacctcccccttcattatctttatattcaatcgttcccttatgcacctgcaccaattcatggctcaaatgcaaccctactccaatgctatctccggagaaactactttgcatgaaacgtttaaacaattctccctgcttttctttaggaatacctactccggtatccgctacctgaatgtataaacacttcttcacctcatccacattcacagaaaacagaattgtcccacccgaaggagtatacttaaaagcatttgaaagtaagttatacaccaccttatccaaattacctttatcaataaacattttataggatggcacagacggcaaaaagcggaaatccatattcttctgttctgctacgtcactgaaacttaaatatatttcgtacaggaaagcaactacatcagtttcctgcagagaaagagccaacttgttgttctgcatttttctgaactccagcaactgattaatcagcctcaacatacgttgtgtacttttatccatgactttcaacggatgcaataaggcttgtggaatatcatccatccggtacattttctccaatgctccttggatcaatgtaagcggagtacggaattcatgagagatatttgtgaaaaataccagtttatactctgtcagttgtttttcaacattgatgcggttgcgcaacctattgaaattaaaaatgatacgatatgtaaagtacaaagctattaacatcaggatgaaatatccaagcatagcccaatttgttttccaaaacggaggcacgataacaatcttcaaagttgtttcggtatcattccaaataccggcaccatcacaatatttcacatggaaaatgtaactgcccggctccagatatttataagtggcaaaacttaacgaagacggaacattccatcccttgtcatagttttccagccaatacatatacttgatttgaccattatccgaataatcgagagtagaaaaatcaagcataaaagaattctggaaatatttcaatgtaatcttatccgaataggctaaagattcttgcaaaggagaacccggcatattaggcttcacctgaattccattaacggacaatcctgtgataacaataggagaaagcaatctctctgttggaatcttcttcgggtcaataatcgtcaatccgtagtttgttccaaaaatcagtttaccgtctgcccccatacacgcactgttctcgctatacacatttcctaatgtataagatgagaagaaataattctcgaaagaatggctgttgggattgaaccttgaaattccatattccgtagcaatccataattgtcccgaatgatcttccaaaatagattgcaccatattattaaccagtccttccgctattccataatgtgtatatttcaaagactgacagtcgtctgacagttcgcatagattcagcccggcacccgaagtacctacccacatgcgccctttgctatcacgaaacaggcaacgaatctcattgctgcaaaaattgccatcggtgtagctgaacaaatgatagttatcttcattagcgatcaatgagtcagggtggaaaatgcagataccttcacttgtgcccatccatatcatccctttctcatcttctgccattactctgactatccgtaagccatacttctttccttgaaagaaacgacggaacttgtattgtcctttttccgttgattctgccagatccagtcctcctccaaatgtccccacccacatacgatctttcttatcgcgaagaatggaataaatattagaatgagataaggcaaaaggattagacggatccgttttataccacgtatctcctatttttagtccgtctccccgggttcctatccatatattctcctgactatcttctgaaatcgcataaatattatagggcaaataatgattatctattttagttttcagatgagaatcataattatacaatccacctcttcgcgttcctacccatatatctccattcgacattttagtcagtaaccggattgtattcgaacggtcaaaaacatccggtgattctggatagacatgtgtaatgcctttatttgaaatggaaatatgagacaaaccggaatattcggagcttacccatatccctcctgttctgtctttcatcaaacataacaaaaaatctgaccctataggtcctgcattcttcccttcggaaacaaagtgttccaaccggtcctcctgaatatcgtaggtgaaaagtccgtttccataagttgaaatccacacaatcccccggtcatcacgcaccacatgatagcgttcataatctatatatttcatcttctcttcaggaatcagttgaaaattctttatttctccgctcttcgagtttatgtaataaattcgtccagtgttattgtaagcccaacaatctccataattgtcatgaataacttttccattatttattttcaattcccggcaaggagttatttgaaaattctgaaaatcaaattcatataccccttcgctagaagtaaatataacccatttatcttttatcaatgaatgtgtactgacagatgtattaccggcaatagcagacagcgacgctaaacagtctatttttttcgatccatttacacagcgatacacatctccactctttgtcagaaaatacatatcctctccatgagggaaagaagaagaaaaattcaatttcctatcgataaattcaactttccctttataaacagacgcaagtccctgcatggtaccaatccagatcctgccactagaatcttcatttataaatttaatccggtcatcgggcaggtttccaaatttcgttctaaacttcacagaggtcatagtccgatcgtcctcacaaacaatttgacgtacaccgttccttctatgccaaagccacacatctccattagaggacataaatatttccgaatagttctctccatcacttccggtaccggtaaaatctacaaaacaagctttctgtaggtcataacagctgaataattccggtacagtctttatccacaaaaaaccgttcttatcctctgccacatgttttattctgttatctgctaaagaaatctgatcgtgttttccactttccaactgataagtaagaaaagtatttccatcataacgggtcaatccgtctaaagtacccaaccataagaaccctttactgtcctgaaacatgcatcgtacagaattactaggtagcccatcactggttctcatttgtttggaactaagttcaatatcagcatacaaatccgataaagaaaaacttaataaaacgaagaggcataataatttatatttcatatagtggttggggttattttgattgctggttacaaagatacatcttttcatagttttttaagatttatacaagcaaaactagccaaaaggaataataaatacaaaaaacttagcagtctatttcgaaacaaggattattatccatatttatgtcattttttccatatactgaccaatgatttgcattggttcataatcggtacggttttgaacaattcaatgcttttctctataacatggtcaattcttccatctccttcacttttctctgtttcttcgataaataaggagtttgcaggtggaatgtctttattctaaaaaggttgtcatctaaaaaaataagaacaagtgaagcaaattctgtatttcaagataaatccttatatttgtatcaaattcgtctgatataaaagttgaatatgataaaaacaatgaataagccacttacatacgatgatatacctaaaatgtatctgttttgcaaccacaccaaatgtccgcgccgcaacaaatgcctccgttttcaggctgcgatgattgtgccccaaagtgttcctcactacgaagcgatcaacatcaaccatgtagcggggaatgaaaaggaatgttcctatttcagcgcatacactctcacgacctttgcacttggcatcagccatatattagacgacgttccgcacaaaaaagctatggccatacaaaatagccttaaatctttaatggggaaaagtatgtactaccgtattcgcaacaaacaacgtcgacttcatccatcggaacagaaacaaatcgcagacgttttcctggaacacggcatcaagacaaagattaacttcgacgaatacattgaagattatgactggtaagccacagattgtgacgggaaagatacttgcgaaaatatttcataggaattgaataaaagtttcataacgatgaaaaaaaagttccatcgcaatgaaaaaaaagttccatcgcgatagaaataaagtttcacaacgatgaaacctgcgaaacttttagcacaaataaagattaacaggtaagcgaagacctaaaggttacacatgcgtcatattccccttataataagaagcctgcgcagacccccgtccaaatgttcaagcataaatattaaaaaaaatcggataccatatttaggcttctgattcattttcgcaatccgctctggacgccagcttctccagtgccaccaattcccatcccttgaacaccagcgtaatcaatccaagccgggtattccctttcgtgcgggccaccttcccatcgtcggcatagcggcgcaactgttctgccgcatcacgtttcagcaaggcgatgtcggcatcggaggtgtcacggcgggcatacttcacctccacgatatagctgtagactatgtccggctggcgcaccagatcgggcatcatgtagaagtccgcataacctttggaagattcgtattcgggaagaaggatgtagccctgcgtcaaccctaagtaagccaacaggaatcccttgacgtgcgcctcgccgtcgataaattcacggatggcattttgccgatgaatcaataccatatctgcttaacatctttatacaagaaaattcgttcatccgtccccctagtaagatctctcaataaaagtaaagcattttgtggtacatggtgaaaggttagactaaaatcgtcagctatttgtttgcccaacgacacccaatccatatcccaataaaaaagctcgtaagtatctccaatacgaacattattgtcatcattacgtgtcatatagcctattcttccaacagattccggtttgcccaaatccaatcctacccaaccatctcttaaagttttagatgcgaaaaatgtcaacggatctaaatcaaaagcagcagaacggctataatgaggattcttacttcgttcttcagaaccaataattgttcctgtcagttttttattctctttatccaagaacatcaattctgcaatattacagcggtagggctttggacagatataacgccaataacgatactttgtagtatcgctcacatttatactacccgatacgctatactctttgaacgtatgtactgtgacggcatcactaaaatcctccttgtgtgctgcttgaaacatgctgtgttttaaacggagtgctgtagtgaacgctttgcgtgttaagggatatttccgttttaaactaatacttcttttggatgtgttatcgggattcaagaactccagttcacctttttcattcaacaaagcaggataattgaatggacgaacccttccatttatataatataccggcagatagacagctcccttctctattttatcaaaggcaatctgcttactatcttttatttccgaaaagcaaataggaatccatttcgcattgtcgaatacagccagatacgcatatctttctttgcgttctcttttcccggaaagtacaggaaaaacaggatcaatggtcgttgcatattcatccgtaacgtcttttataaacacattgcgcaacgttgacgggacactaccagcttctttattcagccggactaaggccgaattgggagaatatgttcttcgatatacttttcctttacactcccccggtcgtaaggcagctaaaaaaggttcatgtcctccttcacataccattcggcgatcgtgatctatcaaaatactaagccacgaatgtgcatgtgcttttgtaggccactgcaaaacgaaatcatacgaaaccgcaaaccccttactgcgcatgatagctaaagctgtgtttgtccttgtctcacaagaattggaaggaatattgcaccaaaacggaaccttatataacgcatgccacttcagaggctttttcaaatcgacaataacggtatcacgtagtttaatattaatagcttctgccgcatgatagggtgttttattccaaatgtcattataagaaaaatcgcctaatgtgtcattagctatcggtttcaacacattgcgccaatcatcaaaagcctgaaactctacgcacttataaggaagcatatattcacaaaattcatcgaatgtaatgcctcttgcccaacgaccttgttgccaatcgtcaaaagccgcgtctatactctgtatcagatagtcggcttttatgacagagtaatcttccttaaactcaaaatcatctgatggaaactctaacaacaagttatttaattcattcacctgttcatcaatctttctgtcggagaagataatcttttcagcttcgacataatattcttcaatatctttccctatatacgactggtgtccgggcatattcattatcaaaaatttggcagctctaagtttcaaactgtcagcttcgttttctttataatgctccaacactttttcgagttccggacgattattgcccgccagtgtcagcaccttttccaactgtttttcttcagagctttgacaactgaaaagcaaaacaagaaaaagaaagatgaatgtagctttcattttgttttattgttagtttataattaaatattctttttacgcaaatagtttctagcctcttcttgtatgatagtaacagtgtaagatggtatctttattcgtttatttattatttctaaagctatccgttcggcaagtatgcagttatcagattttacatagaccctcaaaagtccttgtaatggaagaaaacggctaggacacatacattgtgccagcttatatcgtctttcagcttcttcccaacattccatttgatagtaattatccgccaattgcatttgcaggtcatacgtattgatataagattcgcaatgcaagaatatgttgacgctttgtttgtacaattccacatttttcaattctgatgcataattgtacaagaaatagggattgccattccactcatcatatagcttggtaaatacagataattcattatccagcaaaccattgttcttttctgcaaccaacgaaattcgtttccatgtacgctcgaaaatgatattcttaatcaaaaagaaacagagtataaaaagaataatcaataaaaatggcttgttgaaacgtattgttcgtagagcaacctcccgttgattaagtgaagcgaagcagtagataatcatgaaccaaacaaaagtatatttgaatggataagaaaaacaggaaaatatagcaatagaaacaagcgtcagtatggctggagtgtcaaatgccacattacttcgaaaaacagcaatcaacgacaataagaataaagcgattcctataagtccttgttcaatcagcagcaacagatactcattaaatggataattcgtgtttcctgccaatattctatcgctttcatcagcatgggaggaagacaaatatttggcttgttccggcatgtaatccgccttaaaagaaccaagtccgtttccctgaattatatgttccttacacaatccggcagatactttccaaatcagaacacgaccggaagcggaagctggttttagataaatcagtccaatgaataaacttattagaaacaaagcgcctccgctgataagaaagatgcgccttttatgaattaacttccgataacggagagcataaaaaaggagtgttactacgcataaagtaagtacacctgttctcgaaccggataagataacgactataatgaggagaaggcacgccataaccttgaacgttcttctttttccgttagaagaatgacacaaaagaaaaggataacagagaacgatgctcgcagcaaatccggcgggattatcaaaagaaccggtaactggaaaataagattgaatttctatacaccctacatattgcagcaagccatacaaggccgacaaaactccaacgacagctaaaatgctattaaatgtttctgtaggattttttctattacgcatcaacacaaaaagaatccatccagatacaatgtatacactgtgtatatattgtgatgtaaagagactgcaaacgaaaacatatcccataaaaacagtaaaagacagaaatagaaaatcaacagacagtctaatttttcgcttccagttccctatgcaaatacctccccataatatgatgccgacaacgaaacttatatttttaggcataaaatacctatccataaaccaatcagccgataagtataaggtggtgataagtaaaaaagaaaacgtaaaaacattatcactgaataattgccttaacttgcagaatataaaagagggagtctgtatttgcattgataataattaattcttctttcgctcctaatccctttcctttcggattgaaagaaaaatgaagcgagcacgattcgtcaggatttaattcatacttctccaccgatgcttgtgtacatccacatccagtttcgatctctcctatctccaatctggcattgcctacattggtgattgtaatgctatcacgacaaattatatcagaactaattattccgaaatcgtgtgtataggaagacagggacatctctgccttccttttttgattgcaagaaacgcaaatcagcagaataacaataagaccaaggattttactcattttttatagttgttgatgatgaactactcggaatagtctcgatgaaacggggcgcattatcacgtatactatccaacaacggtttggtcttttctctatattcttctcttttaatagtatagtcccgccaagccaaaagaatatctcgatcggctttgggcattcggtcgagaatccgtagatattttgggaaatcaggatcctttgatgctcttcgtccgttcaacaaaaaagataagtggaatcgtacgacatctggatattgagcatatttctctaagaaaaaaagtctacattcgttggcatgtatgtatgcatctctgaaagatgcacttctattttgaagagaacgctctctatccacttttttttgctgttcgataatacatctgttataatcgtcgttaataggagtacctgatacaatacccttatctgcccaattagcgatacggatatggatattaccaggctcaactataaaatataagcccaaatccaacatatttcttcctgttctggcactagaaagatacgctaagaatggcttttgtgaaagtacaccttcataatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactagaaagatacgctaagaatggcttttgtgaaagtacaccttcataatggaatttcccgtcaaccaccaatatactatcaataaatgaatgtttcatgcgctcatactcttgaccaatggcagaattgttaactaaacgcaaataactattatccaacgaatggtcgggtaattcaccccaaatggtgtacttttcttgtccataaaactgttgagctatagaaacgaatgcgataattagcaatatactactatatttcatttttatatatattaaatttatcatttttcttttttaccatatgccgcctgacaagcatcttgacacccagttaaatcaaaataacaacaatccaaacagaaatcatgactatctacgcatgcctcatatctaggtccctcttgatataatttttcctttgccggtacattttcaagacatgtattgaatatctcatagcaattagttacaccttgttccatatcaccatcacattttttattacaattctcaagtgcctctggatcttccgctcgtgtaccaataacaattttatgcatttgatatttttgccgagctcttattaattctaatcgggtgacatcaactccctcataaacttcttgaaatatagaaaaaattctattccgttcggttcgttcatcatattttaacaaaatattcaattgcactcttgcttccatacgagtttcagaattcaacaattgtttcttaagctgatgatactgttccttcccttctgaagataattcgttaattgcgtttcgccttcgcctaatccccttccttatttctttttgtaagttctgataggcttccgaagcaataaagagatcagcggcagtcacatcttctgcctgttgaaagtaatcgtcagcttcatccgcctgacaactaagcacagaaatactgattagaaaaactaatccaaccataataaagcctaaattcatttttttcataagaactacttttagagattaataatattgaatatctttttcaaggcgataccaagatattagtagataatcgtttggctcattttccagttctgtctatatcaaataagataaggaactgtatttttccataatattagtacgaataaaagtttattgctcttgctgttacaaaggacgacatttataaatttaaatacaaatttcaaccgtatacaaatacgtatacacagccaatgtatatgcgttttttaaagaccaaggattttactcattttttacagttgttgatgatgaactactcggaatagtctcgatgaaacgaggtggatcaccgatcaaactatctaatattattctgctcttccttttaaattctcgttcttttataatataatcccaccacgacaaaaaagcatctcgatccgcttggggcattgaattaataatgcgtagatattgagagagttcagattccctaatcgcgaattatctggaaattcaccttgaatcgtgtatttctcttgtccgtaaaatagttgggctatagatacaaacattaatatgaatagatattttctcatgataataatttaagtgttacagagactccgtttcttctcttcacatatttaattctcctaaaaaatgatacttttcccctgctgcaaggtgatataaatgctcgcacttccattggaatataccttaatataaaagttgcaattacctattgttgtatttgcagaaaacttgatgtgagcatttttctttttatctatatccacagtatattttttcaaaggagcctgaaagtaaagttctgctcctctcctgtatggtatatcagcttgaccgagataaaaaagatcagaaaaaattgaatcatttttaatttctattgaataatcagactcattcaataatataggatctttatatggaagaatgcaagtacctacatttatcttgtagacttttgatgtaataatctttccgacaacttccgccttttgttttttttgttcttttttgctttggggcagaaagaatcggaatttctaccagcattgtcaaaaatagaacaagaatttgcttttttactttcatattagattataacttaaatatggatgtataaaaagcctaatgaaatacggttataggacacataccattgctactctcacaattgcctattccgatttgcaaataatcatcattcgattgacaactaagcatagatatagctattaaaaaggttaacacaaccatattcaagaaagctttgctttttttcataaaactatttttaaggtagtaacatatagggcacttattctcccgctgattgtcaatttcataatcaaaaacacgtcatacaaatcacaataagactaaaattctacttatttttcatcgttgttgatgatgaattactcggaatagtctcgatgaaacgaggagcattgttacgtatactgtccaataatggtttggtctttttttcatattcatactttttaatagtatagtccagccaagccaaaagaatatcccgatctgctttaggcattcggtcgagaatctgtagatattttggaaaattaggatcccttgacattcttcgtccgttcaataaaaaagataagtggaatcgtatgacatccgggtattgggcatatttttctaaaaaaagtaattgattttccatacttctctttgtgccaatcatataggtactgtaatcttcattaataggagtacctgataccacaccctcatctgcccaattagcgatgcggatatgaatattaccaggctcaactataaaatacaggcccaaatccaacatatttcttcctgtccttgcactagaaagatacgctaagaatggcttttgtgaaagtacaccttcataatggaatttcccatcaaccaccaatatactatcaataaataaatgtttaattcgttctttttcttgactaagagctgaactattagtcaaacgcaaataactatcatctaacgaatggtcgggtaattcaccctgaatggtatattttccttgaccgtaaaatagctgggctatagatacgaaaataaaaatgaatagatattttttcattattacgactattaaatattaactcttacaattaaaatttattcctcatctggatagcttttatcacatttttttttacaattttcttcctccctttgtgcagccgatatacaggcatctcttacttttacccagaatttatagctttcaccatctggaaattcactagcaggtaaatctttaatattctcgttaaaatggttatgacatgcaattatatcttctttagtcgtttcatcacaatcattcttgcatttttcacgtaattctgcattggtatctgttcgtgtaatcacaactttacacattcgacttttttgtcgtgccctcatcaactctaatttagtaaaatttacatctttaaaaacgtccctgaccaaggaagaaatacgatcacggttagcttgataatcatatcctgtcagaatctttaattgagtaattgcttctgtacgagtctcaacattaagtataccttttcggagtaaacgatattgttccaagtcttctttagacaatttagagattgcgtttcgttctcttctcatgtcctttcctatttctttttccaagttctgataagcttccgaagcaataaaaagatcagcagcagtcacatctactgcctgttgagagtattcgtcagtttcatccgtctgacaactaagtactaaaatactgattagaaaggctaatccaatcataacaaagccaaaattccactttttcataagaattacttttagagattactaattttgaatatctttttcaaagcaatatcatatatttgtaaaaattgtataattcacttccaattccatctatatcacataagataaggagctgcatttttccatattattagtacgaataagaatttatcgttcttgttgtaacaaaggacgacatttataaattggaatacaaatttcaaccgtatacaaatgcgtatacacagccaatgtatacgcatttaaatatgttttttaaagaaagattattctaaacgtaatgatttaataaaatcggtaatagattcacaagaaacattcattttctttttcaatctactacggcgtatccgaaaagaacttcctagaatatggaacaactctgaaatctgcgcattactaaaatcgatacgtaacaaaagaatgatatgtatatcatcttcagaaagtacagggtaataacgtctcaacttatagataaaaccatcctgatgaagatttatccagaattctaacttattccaattacaatcacttattgctgataaagatgtaacataaatttgtacgtcatagacagtcttccattcttcttcattcatagctggatttttatctattacaattatgccctatttcaccaattcaccattgatataaaggtttttgaaagtaatatctttcgcccctttaatatcatttgctcctttggctacattattaaagtgagaatcctctacactgatattatatacatgtttatcatcctccaatccgataataagcacacctaatttactcttctcacaagttacattcttcaaatgcacattacggacaatcgggtcaaaccctctcttacatttctcccgattctcatattgcagattgatgcgaagtacagcttcacgacattgtcctaccgttacattgcgcacatatacattttctataagtcctccacggcaagtgctcgtcttaatacgaatgacacgatccagattcgggctatccatccggcagtcttctacaaacaagttacggtaaccaccggaaatctcactgccgatcactactcctccatgtccatttctcatcatgcaaccacgtacgataatgttctcactgggaatattccatttacgcccgtcttcattacgtcctgatttaatggcaatacaatcatcacccgtgtcaaatgtacaattctctatcaacacattcttacaagattcaggatcacatccgtctccgttaggtccacgattgaaaacagtcactccgctaacaatcaagctctcgcagaaaagaggatgaatcacccaaaatggagagtttaacaaagtaacaccttcaatcaagatggtgtggcaggaatgtaagttcaatagctgcggacgcataccatcttccggcttcatcagacgcttgtagacaggagtcgatgtttcaccatacatcaacagacgttcacgacctccattgcgttgagccaccatgccttctttccaaccatactttacggccccacacatcggccaccaagtttccatgctaccttgtccgtcaataataccttttcctgttatggcaatattgctttcaccataagcataaatcaaggggtgagcgttatagcaatcaattccttcccaacgggttaaaactgcaggaaaataaaggctttgatctgtagagaatttcaaaacagctccctcttcgagatggaaattcacattgctctttagagtaataggtccggtataaaaagtgcctttaggaacaattactgtgccacctcctgacagactgcactgtaaaatagcctgattaatggcttcatggcaaggattagcctcatcatccgtttttgctccaaaatcagttataagaaatgttcgtttcggaaaagaggtccgtttaatctgtttttcgatacgggcgctttctttaaatgctttatcaaaatcaacagtattcgcagatgttacctctgccacaaaaagcaacatcagtagtaaattaatagttcttctcatcataattcttatccttttattaatatgttatttttattttattgcaatgtaactcccatcagaccgataacaacatcgtttgaaagtgtttccaacgtcagatgacttaactctttggaaggattcagaggcatgtccaaaagtacacctgctcccccctcgatggaacgtccataaacaccctttatgcctaagtcctttcccaagtcattgctaaccaaacccgtcttaaaatgaatgcgataaggacggggagaaacaacggtgaatgcctgaccatcaacatagaaatcctgttcaataggacaccagttatccggattcactaattccaatacatcagaagttccatctgtatagtatacacgaacaataccattagcaatgcgacactgcatgtggttggtactgcctgccatcattaaataggcatgagaagcccgaccggaaagcggaatactcaaactgtcgggataattatcccacaacgaagtaaaagcaatattgcttccttgagccaatgttcggaatggcacacccagtttggtagtcagcatctcatcacgtaccaaggcacgcaaacctgcatcatcaatatcagcagttaatttgggatggcaccactcgccaatgccctgaacaggaagttgcaaagtggtataaggcgaacggggtgtcagatactcattccggaaaatatcagtcacattcgcattgaacaaagaatccatattcatcacccggcactctgacgtattcacctgtgagaaaggaagaatgactgatgttttttccgatttcgtaatctgtacgtttacaggctgccaccattccatctgtccttgtttcatgcgaacaaagaatgtatgatgccccaaatgatcattgaccttacttcttatagatgtatcactaacattcggttgtatcagcactccctgcggatcatatatttcaccgaataccgcccctaaaatggatggaacacggatctccgctaaagcctccgcctgtatttcaggcaaaaccggattcagacagtttcctttccacacaatttcgacaattgctttttgggcagaagaagcaggaataacaaccaccggataaccagaagcagcttccgcaaagctccagtcaacttctttcccatttactttcacagaatgaatcctttctcttccgacattcacttgtaatgtcaatgccaaaggcgccttaaaacgttgctctatccggtaaatatccgtatcattctccctgacaaagtgataggttatgtcaggcaaagaaatagaagcttttaaccatcctgcgggaaatcccggacgaatcaccatcttcccgttcaatacatcgggtaaaatgccatacaatccttgtaccagtaatcgggaagctacccctatcggatctccaaagtcacgataacactctccacgggcagcatcataaaagctgacttgccccaaattgccgggactgttacctaagtacataccatccagaaatgaacttttcatcaatcgatatgcctcctccggacgtcctgcctggaaataggccaaagctgtatgcattacctctgcgaaagccacattattgatactccaggaataaggtaaccaattggtagtggcaatcgttgcatacccctcttccagtccatcggcatacacggggatatgtggtatttccgtatcaacataccgtgtagcctgataagcttgaaaaggatcagcaacgtcgctatcgagtgcatggtatatagtccataatcccggactttcgtgaagccggcgatgtcccataaaatcctgatattccgcccaacaacctttgccctgcatccaaagacgcttattcatcgctttcaatatttgctcggcttcgttctgataaggtgaagggtcttcgcctatcaaagaagcaagaaaagctgccattttattggcacggtagttataagccgacgaatgggtgactgcgccactgttgtagtaaagcgcatcacttgcccaaatacaagcgtatgcatcatataaaccatcattgtccggatcataatttaatttttcccaagctagatggcgggtaatcacaggccacattttgcggacatacgcagtatctcccgtccagttgaagtgccataacaattcatccatgtaacaaagattcatgtcatagtggtgcatctggttgttacgtccaggattccggcaaatatacccattactatattgaggagttccccaacgtttttccgaacgcgccagattcattgtagaatcctgtgccggatgaggtattgtattcgggacatcagtcacctgactggctgcataagcatcaaaatgagtccgtgcccggtcatgccaacctaaagcatcaccggtatatccggccctccacccacttaacggcatacgccagccaatagcaccgtgcaaccaaacctgtccgtcccaaattccatcggcagctgcgaccaatgcaccacccaacgtgttcaaataagggtccggcgtttctatcttcaaatgagaagccaataccaaagaggctgcctccgcttgttgataaagtttacggacattatagccttcggaaacctccccacgtaccaagtatacttctttctgcaaagaaagttcacctgtgacaaggtcagtcgcttcggcaggaagttcgaagcaatcagccgggtctacccccatatctccattacgactcaaacgttttccggtagctcccccatgttgccaacgaagtatagctcctttaggcatattcgaaggagaaaaacgccaaatagctccatccatatcggctaatgccaatacagaaatacgcagttctccttttccccaagacgggtctgtcaaataataggtacgttttccagccgaataacgggattcacaatgcccggtgcagtcaagcgccaattctgttccgtcacgaagaatgactttgaaacttatatttcctccgcgtccgttattataaaaagcaaaaaccggccggtcacttgtttctacccgaaagggactgtgactaccgtacaaagcacgggtataccgattcttaccattgacacaaacaaactcatcaccatcgggacgatattgcaacgtcctttttgtacctcgcagatgttcattcaaggagatggattctttaaagtcaccgatctgctttgcctctctttgagcatttaatggcatcgccgacaacatcaagaggcaacaaacagtcagctttccttgtaaaataagattcagatgaaaataactcatatttttttgtgtttgattatggtaatggcttcaatccttcccaacggacattccaagttccatctttcggaaatcccggattagtctccgtacatccgtcccaaccggcacacatcatcgcaatagcagtcagcaagccgccattacccggtaaataaatacgtaaacgaccgtcctgataattatgaccattcggcaagtatgtgtttgtacgtttgtccatcagtaaagctccgacggccttttccggttcacccaaacgggcagcattcatagccgtcatcggataatcccatccccaggttttaccccaattccagttatcccaaatccagtgcaatgtatttttcatataatcttcccggataagtttattcatcggaagaataccgactgcacctaatactgccatgtggtcggaagtataacgaatatctttataagtatctatggctgtttcagcagccagataaagtccttcattattagatgctaaaggggaaagtttatcgatcatttcatcccattccaaactgcgttgctgtcccatacgttcacgccattgttgggcggtctgcatggcaaaatgccagtaagaaagttcaaaaggaggattaactgtttctgcagcacgcaacgtttcttgtgcaggaatggcacctttcaatatgtaacgtccttccagttcatcgtatgtagcaaaagagtacataaattctgcagtctcctgtaccaaacgattatatttctccaatacttctttagtcggatcagcacgataaagtaattctgccaaataaattaaatgaggttgttgccaaatcagaaaacttcctactttggaaggggcttctgttcctgaaggatcggtcattttcatccagcgaacaccatcaaacccttgtctttgagctatttgacgcgctatcggttcagccttttcataccagcctaatgtacggtcaagtaagttgctacgattccaaagagcaaattgagcctcgtgccaccagatcatttcaagatggaatttgccaaaccacgaattataggtaagccccgtctcttgcggaggagtagtacctgcgctctgaatagcaagcaaatattggctaagtaccacacgtcgttccagttctttggcccgtgggtctgtacatgccgaaaagtcaacagctgcaccttccttccaaaacgaattccaatagttttttgcttcttcttgagtttgtgctacagtaacaggctgcattgaaggagctgtactagtaaaagcacatgcaaaagctaaatgatcgtccatcggagtcaggacaaaataatgttttgctttctcattgaaagtagccttcccttcccaatacaaagttacgaaatactctatgctatctaaagtatgtttcaaaactgcggaagattcattttgagtaacaatagtcgttgtatgtttatcaacggcttcccaattacatgcatcatcacaatgagcgcccgtaggatacggaaagcgaaaacaaatcccggtatgcgccttagaggtaatatttgcagcaatcatatcattagaaggatggcagactgtctctacttgataatcttcaccgtttaatttaaaccgactttcgatttttccatcccacaagcaaagtttctgatgaacatcagttacctgttcaatatccgtaccttcctccacgtcaaaaccgacaattcctaaatgaagacgatgcggattgacacgaaaccaattagcggcatcctgctgtctgccttcttctttgaattgagtagcgtaaagttctttctttcccctgccaaaatcgtattctttcagggtttcttccgaagtaagccggtccggattggcgaagctatgccaaccccactggctctgcgttcccaacggaactccttttttataattgtccggaaacgtctgtaatccggttatgtctaccgtataagcaaactctccatttcctacagaaagtgaagctaatgaatcgaatgccgtcacaacaggactattcctttctactaatgcctcgcggtcaattatcggctgatttccatctccgcaagctgtccaaataaaaagtgctgcaatagatactgcgaatgttttcatgattctttattattgttatttacaaaagtatttatttttgaaacaaatgacgcggattctcattcaaaaacccgcgtcactccaccctaataatccaatccaaaggatgatttgaggatctttattttaaattccatttgataaaatagtctccattcattattttggaacgaatgtcttcagcattgccggtagtttcgtacttttccgaaatatacttcgccatgaaactattatcattataacgttttgccatacgaatcatagccggataaacttttccttcgcatgccatttccagcatcatttctttcaatatttcttcgtcattgttttgcttatcggaggtaaaggtacgtgatcctaaaccactataacttacttccgttccacgaatccccttgtcaccatatttacggctagcgattcctgaagttccatttgaataattgtatacggtactagcatttgtccaatgaggggtaaacccataccagttaccagaataagttccttcttcattaacgtcgaattcactaatatacccactaacaccaacattaattaaagcgtctattaccgctcttctacccaactgattgaaagcttccgccaacatgaaatagaggtctgcccctcgataagtatacacaaatacgtcatcacgataagcagcacgcaaaggactggaaatcggacgaaatttacaaaccacccattttccattgtaatcataaaccgtacgatccattcggaaatctttggtttgattacccagcggatcgaattcattgtctttgaaacgttcaactgccacttcggccggtgctaaccaatatttattcggataatcagaatcgaaatgtttcaacagattgttcgtctgtctgttttgatagtcatacatgattgctgatgcagattcataatcatacggtgtctcattattaaaaaaattattataatgactgaacaacatatcattacgtaaaaaagcaatagattgattgttggtcttttcatacatactattcattttgttaagtatcatattgatacactgctggtatctacctaaccacaagcaaatctctgcatataaagcataataaggcggagtcatcatatcccaacgacgatattcactgttcgctaattctgtgtccggatctacccagtctttccaagccgtttcataagttccatcaatgttatcaaaaccaatgtctaacaaattcttacaagcaaccattgtttcatcaagattcaacacgtcaaactttgacaagtctcttaatgaagtcatcggtttatccacccaaactacctctccatagattttggcaattgtcataaacatccatgtcttaacacgtagcgtactgctgaccaacgccttgtaatggctttcgttaatagaattattttcttcgtatgttttcaattttcgaagataatcgttgcaagcattaatcacttcgtaaaatccggaaggatctgcatacgaattaccactcaaatcatcatcataattatacaagttatagagttcagtgggtgccgttgcagtcggcaccaccatttctccacgaagttcattcagataaatcaccttgtctccaatagcttgcattttagtcataataccaatgtaaccggagtacatctcactttcttccgatatataatcctcattatcgagtgtaacatccgtatcgggattaaagaaatcatcacatcctcccaataaggtagccgctagaatgaaagcgacatttaataatatttttttcatcttcatcattagaatttcaagttaatacccaatttgacagatttcggttgcattactttcgcataatcaaatccttgtattgcactattaccggacgagtaagcaaattccggatccagtcccaagtatttagtagcagtaagcagattttctcctgtcacatacagtgtgccggaacggaagaacttccaaactggcttatcaaaactatagcttaacgtaacactcttcatgcgcaaataagaagcgtcttcaatccagcgagaagaaaatttgttattgccaatagcgtctccataattggcacgcggaatattggtcacttgtccttccacactccaacgattggctacagcaacactttggttggaaaaagatgaagctgattccaatgtctgtcttactgcattgtaagcttcgtttccttttgaatatgagaactcagcagctaaagcaaactgtttgtaacggatgttggtgtaaaatcctccaaaataatcaggagtagcactacccaaagatacataatctttagaatcgatccgaccatcattattctgatctacataacgtacatcaccggcacggtatggctgattactactgttcagcaatgctgcctcttctgcctccgactgagtggagtaaacacccgttgcctgaagtccgtaaaactcatatggattacctcctactcgactcaccaacatggaaccgtcttcatattcaattacttcttgttccttgccacctaacgacttgattttgctttccataaaagaaatgttacctccgacaatccattcaaaatcacgcaggcgaacaagtgaagcctgtaaagaaagctctactccattattgtcaatcttaccgatgtttgcataataagcagacgtaccataaactgcagatttactaatgttcataataacatctttgcttcttccacgatagtaatcaacccctacgttaatacgatttcttaaaatacttgcgtccaaactcaagttcatttgtgaagttacttcaggtttcaagtgtgtattcggaatttgtgtacgcaaaatacctgacactgccatatatggtgaactactataatacgactttccgtaattggaagaaaaacggctgtttcccatcagactatattccgcgcgaatatccagacgatttatccaatctttatcaatcaggaaagacatgtttttcatcatccaggtggcactacctgacggatatacctggaaatgatttgtatatcttccgttggcagaagaaccgtcaattgccatattgaatgcagtattcagaacattattataagtatagtcgacatgagcatagatattcgcccagttccatttgttctgataaccatcgaaataacgaccaacagcatttgcagatcccaacacctgatagaaatcattagtagtgttacgggcatatgctccgtcatattcctgcaaagtagtcattgcctggaatcctgccataacgttcagtgcatgacggctgttgaacaacttgttgtagcgcgcatttaaattataaaagtagttagtggcttccgctacaccttctcgtatcgtattttcttctgtaccatatgagtcggtgataggaacaatggtaagatccgtacgtcccggaacaaaaatgtgttctttattgtaattataatacaacccaaacacaccaccaagagaaaatccgggaaacattttataattgaaaccagctttgatattgacgtcatactgccgacttctcgcatctaatgtattaacaatagccagcggattacttacggcataagccatattctcgctaattccataataataggtagaataaaccggagtaaatattccattatcagatttttggtaaggggccagcaacggagactgtgcataagcagtgagtaacggattggtacgcatattcattccttgttcctgataattgccattgatatatgccaatccgacagtagcatagacttcaaaattcttactcaccaagaagtttccgttcaactgggtatggtagcgattctgctgggtacttttcaatattccatcttctttagagtaccccaaagataaatcatatttagcgatagcatcaccaccttctacccgaaacagattctccgttacgaatcctctccggtagatttcatcctgccagttcgtattgttattgtagtagttagcatatttgctgttattaggatcactcataaaaggaaattcagtaaagaactcatccatattaccgaaataactcatacccatatccgacaaatacgaacggtagttgattccgtttaataatggcatacgcttattattccaattgataccaaattgtccatagtaactgatttccgtattcatgttgtccgaattagcaccatctgtctcaatcagaataacgccattagcacccatagaaccatataaagcagcctctgcacctttcaaaattgtaatattctgaatatcctgcagattgtaagcttggaaaatattacggctcaatccgttaatcaacggagaatcattcacgtccggtatatgaggtataccattaataacaactaacggagcattgttacccacaaacgaacgtactccacggaaattgagataacttccctctccaggcataccgctaccacgagttacctgcaaaccggcaatttgtccagccaaagcacggtctatcttcatgccggcaggcacaaagtcttttttggcaatattctcagcggaagtagtaacaccgtttgtctcaatacggaaaggcaacaccgttgtctcattatacttatactccgattcgggaatcagaataatagacatctccttacggttatttaccgcctgaaacactgtataatacccggcagcccaaacagaaatattggctttctgcggatccttgcattgaatttgaaatactccatttttgtccgtagtgacatcttcacttccggtgacagagattaccgcaccctcaatcggaatattcagggtagataatattttaccgcttattttgccttgttcctgcgcatacagattagctgcgaacaggcaaattaacagggcgaaaaataaaacttgtatctttttcatgttgtctttattttcataagattaataacagtccttagttggtcttaggcaccaatgatataacgatgcgtgtttcaagttgcttccagaacctttaaagcgtatcacaatttcagaagctttatcacctggaatagtaactgtgcctacagtaccaccgtcacgatcgtattttgctttatctttaaatccttgtttaacagcttcatctatattttccgggtatcccccttctttaccacggtcataatggagagcagaattgttgtttagtttagactgtgaaaaagtaccaactttaatttcctctccatctttgaaaattgaaaaatcaatcgctcccaagtctttagcttgccggaatcccatagcaaacgtgtaagttccaggtggaattttgtatgaagtagcgacataatcttttcctaccatttcacctctaaacggagtatagtccagcgtataatttttattttccaaatctgtcagagtaaaataaagtaccctatatcctatcttgggaaatcctaatgccggccatccatttatagttgcttcgtctgtttcactgatcttttcaaatgaaagattcgtagtgttgaaatacttttctttatcacttgcgctcagatattcatagtttctgaaaagttccttgagacggtaaatcaatacgttagtcggtattttcatttttgtgacacggtaagccgttccgttactcataggaatcggattttcaaggtctacttcctgtacagtagtacgccattgtttatcaaatacagaagtcagatcttcgtttgtttcaaaatcttccttgctataaacgttgttaaaaaaagcagcttggaacacccaattctccaagatgctgtctgcgcgtaccatattccaatcagccaaatttttccgtgcggtactcaaggcctgattcaccacatcattggaagggagcaacatagtagcagtgagattctcagacatgatgttgaattttctattctcgaaataaggagctttgacggtaaatacagaatcatacacagtatttcccgtcttatctactcctatcaccgtacttgcatttttatcaaatgtcaatacataacgtgatctgaccatattacgaaaaatagaataatcgtctcccaaattctcaataatttcatacagacttctcggagactctacagcctgatccaataaatacaaatatccattggttagcttaataactttagtaacatttgcattgttgaaacgaacaccggcaactgctctagtctcaggagaagtggtagaaatctttagatacttaccactccacatcaaaatacgctgtccgtcttccaaattagaaggagagatggatgcatcagaaatataggtttgagcagtatatataggatcatcccctgctgcaatacctgattctacagctagaatagtgtacatctgttctttctccaatagttgctccaccatacctgtttcgttaaacaattggtacatatcgctcaatgaaggctcctgagccaaataatcggtaatggttgcattaactacagaaatctccgtattattcaccttactggtatcttgggcataatgctcatcccatgtgtcggtacaactactccctatcaatccgattagagcaatgccaaatatatattttcttgctttcataatttattcgtcaaatataggttcaaataataagtaatcaataagtatacgatagttggggtctttacttgcagcagggtcattcatcactaatcggaaagtgtgagtagaagtctctgtaaattccagttcaggataaagcacataggaataacatcctaatgttttagaaggaactgtcgtataaggagcgcatgtaacagagttttctccatcaaagctgaaaatcattttccctccgttactgccgcctgtactggttcttataaattccatggaagtggcgtaaccaaatcgtaatgtcactttgtactttcctttaatgatagatggcgtttgcatggaaacccaacctgtattacccaagtttaacatcaggaaatccatattatttgcagtattccatccattattggttcgggtagtaaaataagtgacattgtaataactaccataagttccagaaggattattaaggctatattcataacaattgagacctgaaacatcacactttttctctgctgtaccaaaagattcttggaatttgatcccatcttctccgttaccagccgctatccaatcgccaataatagaataattgcatacgtcaaacaaaacagtttccggttcggcttccgccacaggcaagtaagaagaaacttgatgaatataaccatttttagcttgtaaattacaatagtcttctacaaaacaagctcgattctcatccctgtagttcaaatagaatatcttgtcttctttgctgattcttatcacgcttccagcattcagtgtattccatattttggaggttgcgtccggtgtatcaaagctacgtaatttactcaaatcatagcttccatccaaaacatgataagctacatattgatacaatgcattctctggattagtataatcactgcctgctcccaacagctgtaccaagtcttgcaaactgttgacacctgcttccttgaatacatcgtccgatactgccaacaatgtataattgcgtttctgctgagtggtctgacccaaatcatctactatatcatcatatataacatctaattccgcacccactcctgtagcatccattgcagatttcagaattgtgtagggacgtccgctttcagatatacgagcatatacactttctgtaagtggcgtcagcgtattttccaatacatatacataaccgttagataccttatttgcaaactctattacatgagcttcattattcaagtaaacagactgcataccaccacctccaacttccgcacttccgaaagataccatcaagacatcatcagaaacggtcctttttgctaatgccccttccttctctatgaaaatttcctgactaatggtatcctgtactatgtgataggacactaggctacgtgcatactctgtacccaaatcttcaatggaagaaactccttttcgattataaaattcttttacagcagcattattaggtacaaaaagtgtaaaagactgtgttgcctgatttacagcattgtacaagtctgcatacttcataatgtgaatccattcggaaaagtcgtctgacctgttggacaaataagttcctgcaggctgcatatcgaaaacaacatatgtatctccgtcatacggatcattgcaagctgcacataaaataatgaacagcatccagtatatttttttcatttttttcattgcatatcgttatttaattattcataataaggattttgcttcaataacgagttggtggatatgtcactggcaggaattggcaaataccaagcattgtcgttgtctaaaacagagcccaaccatctgctttccgcggtaagattattctccattataagtattttgaagcgacttttatatttgaagttctgttgcttgccatatcgtaacagatcgtaccagcgctttccttctgcagcaaattccatatcccgctcgtccagcaacatttccaacaatatttcctcagtagcttcattaatattttccgcactgacttcatctcgtggtctcaactcagaacgttcacgtattctatttatgatagccaatgcttctgtccaattggcagaaccgccaatacgaatcaaagcttccgctttcatcaacatcacatctgccatacgataaataatatagttggcatccaaaattgtacgtactgcttcccgatcggctacacccaaccctgagtatttccaaataataccattttccggatagctggtataagttataccagcaaacgaaccataataggtacgatttacttcatcctgattttggtagaattcatttatcaagcggatagtcatcggttctgaatacatataagtattgaccgtgacgtcagagccataaggaagaagttttgacggacttccgcctccttgtgcataattcgtttcgtcatactgtatctcaaagatagattcattactattaccaggataaaatatattgtaccattgtccaggtgttgacataaacacgggacgtatgggagctgtggagttaatcaagtaatcagcgtatgtaacacattcttcataatcttccgcccaaagacaggtttccgccattagtgcatatagagcccatttggtagcacgtcctttagtagcccatgttccgttaaatgtttctttagcggcatcagttgccaatgctgcacgtacatcacttttgatttgttccagaatctccacttcggaagactttggcacgtcagtaggcatggcatcgtctacataaggttcagtaatcaaaggaacttcccgaaagttgcgtactaaatataaatacgacagtccacgcaagaaataagcttccgtcaaatgtgaatccatttgcgattgatagtaactctcgtctttctcaattacccctggtgcatatttcaatacagcatttgccataccgattacttgatagaatgttccccattgaacggctgatgtactgggcaatactgtaaaattctgaatttgaccagccggagtcgatcttaccggaacaataacggaacttcctctcaattccccccaatctatgatatagggaacgcaatcacgcaaacgactgtaaccttgtgcaagaattgcctctacatcttcggaagattcccaatacatatcggtggattgtttatctttaggctgtacatcgagccaatcgctgcatccgctcattaataagccaccgaatagtaacaatatagtaaatatttttttcattttcgtaaatcttttagaaacttaaattaaagccagcaacaagctgaatagaagcaggtgtagtggctgtatctctggcatacgtattctcagtctttacctctgggtcctgccctgtgtacttagtccatgtgaaaagattgtatccggttacgtacacatcaatattgttgaatccccaacgctgaatcgctttcttcggcaaacgataggtgaatgataaggattttaaacgcaaataggaagcgtcttcaacaaagcgatcagatcctagtgtattgtacccctctccataaagtgcacgtggaatgtcggtttgatcaccttcattacgccaacgtctgaggacagccgtactttggttatcaataccacgcatagactcattattcaagcgagtagcgttaaccacatcctgcccgtaacgcccatagaaaatagcagataacttaaactgcttatagctgacattgagtcctgcacctcctgtaagtctcggatttgaattacccaaatagactatatcgtactgattgataacaccatcatgatttacatcttcatagattgcatctccgggagccacggtatatgatccattcctcataacaattgcattaccggaaatatctttcatcacgttaccttcaatgtcacgtgcataagttgcgtctttattttgataaacgcctttgtaacgataaccatagaacgatcccatcggacgaccttcttctctacgatatgcgtaattaccattaccgaaagtataattctcttcgatataattatcaggcatttccgtaatcttattctcattgtgggcaatattgaagtagactcccacacgccagtctttgttttggaacggaacagcgtcaacacggaattcccatcctttatttgtcattttcccggaattcatgtagctaatttgataaccatttccataaccgatagtggtcggcatctttacctttggttgtaacaggtcttttacatatttctgatagacatcaacagtaaagcgaagtttgccttttaagaaagtagcatcaagccctgtgttatattcggttgttgtttcccatttcagtttattaagttgcatagaactcggagtaatggcactcatatccatgtagttattcccggaagcataagaacccagatagagtgaagcaccactggctgaattcccggtctgtcccaaactaaaacgaagtttgaactcatccatccagtcattcgaaaaatccatgaatttctcatctgccaaatgccaagctaaaccaacagtaggaaacataccaaaacgttccgatttacccatggtcgaattgctttccatacctagtgaagcattgataatgtaacggttcaataaggtatagttcattaaagctacaccgttaatattgcgtgttttggaatcaccagaactaattttgcgtacagcacttccaatggtaggatcagcaagtcctgaagatacgttaccagaagtttcgcttccatagctggatttattcgtttccgtagtacggaatactgcagtcgcgataattgcatgtttatcgttccagtttttgcgatacatcaacttattttccgtatttatagttaataagtcagaagaggtatccgtactacgatttgacattttgtctgtccatgcaagaccagtagccacctgtggcaaaaacatacgccctttagtattacggatattcatgttaacatatccttcataagtcagtccattcaaaatgtcatatttaatacgaaaattcattttactttcccgctgtatggttcggttgacactctcatttgccatagcaataggattatagtacttatcaccattaaaagcaggatccaatgtagaattttcattgtgattgaaatactgtgatgtacgattccctgtctcatcgtcaatgtagtaaggtgatttgttcggtgctttgcggaaagcttccccacgtacattataatagttattatttctctcagattgagtataagagaactgtgcataaaaattcaatttgtcagagaacttataatttacattcaatgaagaattcaagcggctgaaatcggttccgacagtcgtacctccttcgtccaaataacccaaagaaaaacgataagtcgctctttcaccaccaccactcatagaaaacgtattttcccatgactgagtattccgacgcacttcggacagccaatctgtattctggttatactcgtcaaaatatgtccaatccggctgataaccgatctcaggagaaccgtaaagcatttgcaagtagctggtagagttggcaagaccaatataattggcactattccacaacgcttcagataccaaagcagaatattggttaccgttcaacatcggaatggtttccggctcaaacttagcggaaaatttggatgagaaactaaaacgtgttttcccttgtaccccctgcttagtcttgataaccaatacaccgttggcaccggaagtaccccaaacggcagtagctgctgcatctttcaacacttcgatagactcaatatcttgcggagagatattcaacaaggcacccaaatcgtcattattgatggtagagaaatcagtattatcatcaatttctgccggataaggaactccatctactacaatcagtggttctgcattagcattcagtgtactaccaccacgaatctgtatggaagcacgtgctccagggtcgccaccacctaatacaatatccacaccaccgagctgtccttgcaaggcatcttcgatggaagttacaggagcaacagccaccaaatcttccatactaaccttctgcgttgcagaagattgttctctagcactgatacctaagtcattccgttcgattcgttttccttgcacaacaacttcattaatggtctgtgtatcatcttttaggacaacattcaaccgtgtctgaccgttgtatttgattctttcactcttttttccaatataagaaaaaacgatgatcagattgttctcattcgggatcggaaggttataaataccgtccagatttgtgacagtaccacctaaagaacggttttgggagttgagaatatttacgttcacccctatcataggttctgctgtcgtcccgaacatctcggtcacttttccagagaggactttcgcttgtccgaaagcttcgccagtagttgctgcgaatacgatagcaatcagtatgtattttaataatttcataatctctgtttttctgttaatcaaaagacatcatcaatcagatggaaacaacctccttcgtatgcaaatgggaagtaatcgtaatctgataccacttgacatttgtttccaccttccaattggatacttagtgaagttccattatctgtataaattagctgcggtgcagtagctccttccgtctgtaccacacgttcactccaataacgcccacttttaaaatcggatcctatatacggataagatggaataacgttttgagcagcagtaataaaataggaattcaaataatttgccaattcttttgcatcaaatgtaccacttaacttaccttcagcatcaaatgaagcatcaatcgctcctggaattttatttgatgccaatgcccgctttatagcatcgttagtcgggataaatgcaacgaaccgtcctttaccaaataaattcatcataatctgattggatataagatttgcctcacgcaataactgagcaaaacagtaatagggataattgtgatccgcacagatagcaatgttataagccaaatccccgctctctgctgcaaacaattgttcagcatcaaagctatatgtacttccgttacttccatttttaagtttagtaaatggtgtaaaaactgtaccattgaactgaggattcaactgttgattgaaagttgagctacaagtgatgtttccatctttaacgaaccagtagttccaggtagactccgtaggaatcacacgcgttcctctttctggtaattcacttgattgttcactcgagatactagctgaatgcaaatacacgatattttgcttggcagtattgctgatttccgcccatccatcatctccttctgcttccaacccctgtgtactgtaaaccgtccgaatgccagaggcttcaaattgttcggctgtaggaaccaagacaatatatttactcaagtcagacacataagaagagaacagtgaactccctaacaatgcgtagagaaaagaacgtgcacttttatattgaaacaaaggtccgataacggaagcaaatgtgctaggttccttaatttcatccataccatagagagcaccattaacacacatcgttttttcattcaatgcagcaggattaatattaagagatgagcccgccaaattcttcaattcatcgtctcctaactcttcagggaataacatactacctccataaataaattgatagaggaaataattcaacgctagcgcatctacttcctgcatagaagaataaccaccgattttccaaaagctatcaaagaaactattaatagcagtgtttgacggtgcaaaaatactataagaaagagctgtcaacgccgtaaaattcaaatagctgcttgtaggccattcacaagcaatatttggcaatcccccatgctgatactgatagagcgtatccactccgtatgctttagcatatgacttactcaattcatcatctgcaacgtaaacgccaaacgaatcatacaaatcaaggaaagtcgagtatttttctttatttttcagttccgtataaatcgtttctagcggttcaacgactcgatcaacagcatgaatatagccgttattagcaataattccatattcttttacagatgcattagatacattgaaaccatcatctcccgtccaagtagaattggggtagaaagcctcgtaattatttttagcatctatacctttcgtctggaaataacggtaggaaaatataggcaaataacgttctaagtgatacaccatgacagaagcccctgtaggggttgtctcaacagtaggagcatcgctacttcttgtgcggtgtttgtaatacaatcctgcttttatgttctgctcctcttccgtttccgtacttcctgttggacggaaattgactagtttctccttattataagaataatagagcacgtggtacccaatcaatttactcacttcgttaacaggcatatcactgatgctggtaaatcctctcttattcaaataagtttgaaaagcatcgtcgtctggagcaataatagttaaaattgctttaccctccagcatttgcttgtagccagcaatctctagcccctgcaagaaaatagaatagtttccgtgttcaccggaacttaacacttcccatgcattgtctgctacccaatcaggtacttcatagtgctcatccatgctatctttacatgcagttaagagtaatggaagacatagcagccaaagcattctccgtaaaaatactttgttgttcattttttttattaatttaaaattaggagttctctctatcattattcaaaattcagattaattgataatgtataatcttcattatttattgtatttcactatttattcaccgtatgcttcattccaagccttttcatactcatctgggaattcgagtgaaagagcatagttttcaatcatcatatatccgttctctgcaatacgaacggcatctccagcattatttttatttagcccccatttgtcctcaaaatcatcgggtatgccgtcgccatccgtatcttttctagcagtgccaacattaatattttgccaagtcttggcaagagggtattgtgtctctatgttttgatttctaaaaattgttcctttagtacctaatgaagtcagttcatcaatcatgaatttatctaccaaatcacgattgggtaaaaccggtccaacatttttaacaatccaatgataagcttctgtagcactagtttttatgctgatttccgaatgttggctatctggtttactcagaaagacaggagtggcactacaataggtttgccaattaccctgagtgatttcgaatccatttaatgtgccgtctttatcgttatcataataattacctacacaataagtatcaaaatcaccatcaccattaccacctataaaaggtttagttggatttacttgttgataagtatctaccaaataatttttattgtcactacttattccattataatgatatttcgtttcatcatcgaacatactcttatctgtagtttctataggatatgacgtattcacccatgtataagctggtcctttgataaaataattattttcaataactgtgttagagtgccctgaagattccccccccatattataagccgctccatttccccaattatagataacattgttaacaaattgattcaatcctttcactttaaaattacgagttttattatcaataaatagatttcggaaaacagtaactccttcttcatcactagtttgaactaaacctccacaagaatgattctggcatccttgtcctaaaattgaattctgcaatgttatgttatagagacctttcggttgcttgtcattattgagtgaaaaacattcatctgttccccatgtgaaagaacaatgatcataaatttgatcatgcccataggcagctcctcctgcgtctatgttgtcactgccactaacctggcgaccagtacgcatacgcatataacgtacaatcagattatttgcattggtggaagaagtcctaccattataaagttcgatgccatcaccgggagctgtctgaaacaagactgtttgattgtccttaaacacaagtacttctttattcaaatcaatcacacctgacacgttaaacactataattctgtttgcttgactaacagcatctcttaacgatccagcaccactattattcaaattagttactacataaatttcccggttgttactaccacgtgcaccatcagcgtttctaccatatcctactgcacccggaaatgccggtgcataattggctaagacaggaaatgccggaccagaacttgtattaccaccactttcttcctcctctagatatgaactgtaaggattgatagcaggatctgcatcctcctcatctacaggttctttatccacgcaagccgctaacgacgagagtgaaaacaaaaagaaatataaaatgcttgttaagcatctcacggcaattggacatgcctttttttgaaaagttgctgtgtttctcattttatataaaaaataattaataaatactcatttgattaataaattaaattcaaacctaaaaaattgtatatccgttgtcaagtatacttaattattttgctatttacgtaatcagtagttgaatatctattttaatattgatcctcatctttatacgtaaaaatcaagactttttagttattaaggtacaatgccccattgtgatgcataagcatcctgaatttctttggtattgaaacatacaatctcaatattaggataataatcaatagtagcatctatcctaactgaagattcgtctaattcatccataggataccattctgaatattctccgtcatcccattctactctataataagctgaataccacgaaacttctgtttcgccaatcatagtatcaatatttgactgtaatttagcccatatacctgttattaaatataatttatagccaatatcatcaccatttggtaatcttaccattttatgccaacttacattattaacagccattccattcctatctatagaaaagtcttgttcacaataccctttataacaatattctttttgagtagaattatatacaattccaagaacaaagtcaatatcagttggcctagctggttcaaaaatggatctccattgataataagtattaacactaacatttccgtttacataaggacctgaagaaccatcgtcgtatgtttcatcataaaatcctaatgtaatatctaatgtgtaatcattgttttcagtataaggaaaatctacatcaaattcaacagtaaaggctgaatttgtgaaagaagaatccgctcttttaagaataattctatcgtagagcaccgtacttgcttcaccgttctttaaggttaccaaagcattgcatagttcaatcggatatgtatatgatttaccatcatcaatttctatattcaatttaattcgatgttttccgaaaggtatcaagaaattaccttttacattctttccactttgtggataaaggcatctagtaagatcttcctgattatcaatatatacaaaacactcatctacatgatcacccgtattatactgataatcaaaataaggttttgtgaataaattcagattaaccatacatgtattatcacttgtcccatcatttaacagtccttgctgcacatctccttgcatcaatgcagtctcttcatattccataaggccattaccatcacatgagatagcaagcaaaggaataattaaaaataacatcgatttgataatttgttcttttttcatggtattacattttatttgttcattaattgaaactgtagtcgaaaatttcctatcatttctatttctatattatttgttcagttcaatacatcccataatgaaaggtcctgttgctttagcatcattatctctcattttctctcctatataatactcaaaactaccgtcacgataaggcttaccgcctaatccacccacttggcaacatcttgtcaatgtcaatgttccgtccgaatttgagattagcagtttattgcacagccccttaaaggctttttctgcaatagcacgatactgactatcaatgtatcctttattcacagctttcatataggcatacatacattgcgccgtaacagaagcttccgggaaattaccggtacgtgaaggttggtcaattacctgataccataaaccatttttatcttggtattttgaaagagtttctgctaattctttcgtccatttaatcatatcagcatagcctgaatgatcttggggaatatattccaaagcatctaccaaagccataaaccaccaaccaatactacgtccccagaaattaggagaatggccagtttccggatcagcccagcgctggctccggtcctcattccatgcatgataataaagtcccgtcttggtatcgtatgtatgctgatggcagagagtgaactgtttaacagcctcatcaatccattccggacgattaaattcagctccatatcgagccataaaaggagaagccatatacaatccatccaaccacatctgattagggtatattttcttatgccagaaacctccatctgttgtacgaggttgcttttttagctgatctatcaaattctcgatagccaatttatatttctcctttttggtttcattgtacaaatcaaaaagaacttttccggaattgatataatccaaattataggtttctttcttatataaatgaatctctcctttgtcgtctaccaaagaatcagcccatgcctctacataatcaaagtacctacggtctcctgttttcttccaaacttgtaacatcgcacaacaacctactccttgcgcataaccaaaatacaggcgttttccatgatccagttgccacgcttccggaaaacgacgaatttccgaatcggcaaacagacgataataagtgtcggaagaaaaagtatccgtacggaaaggaactgccggaagtccggctttattaaacagattcactctaaagaaagtcccataaccgtagcgtacagctacaggtgcagagacataagttgaagaaagtgttatcaaacttccatcaattacagcttcagccggataaaaccgcgcatcattgccggcaataaaaaatccttttaccggttcattgccgggtgtctgcaggccaccttccgcaaattcaaaatctaatgtaatttctcccccattcactttcattgatttgtagagaggtcctgaataaacaatctttttaccatattgctttgctaatgcccaagctgccagccgttcgcccggtgcaactttatttcgtggatgtatgtcggtagaatcggctgcatccgtcactactgccataccaatattttcaagtccacttaaccatgtttttaattgtgcttcacgaatacctgccggttgcttgtaatgtggtgcaatctgtacgaaatagaaaggcatatccggctgattccattctttccgccaactattaatcaggttagtaaatacttcctgatatttctcataacgaacagagttggattctccctgataccagatatttccttttacagtgtaccctactataggagcaatcatgccattccacaaagtagccggaaccttacacttatctttttccctactcaccctttcttttgaatattgttttaagacatcagcatacagcagattgttttccatcactttcatacttgtccaagattcagcatgtgttcctccccaagtagactgaatcaatccaaccggtgtactcaattctttatacaatttacgtccaaagacaaatcctacagcagaaaagtctttcagattctccggattacaaaccacccactttccaacgcaatcttctttctcactatcaggtgccagttgatgctctacatgaaacaggcggatttccggaaaatcagcatctttcatttcttccgcttcattcaacattcctgttttccatttcacttgcggattacgggctacgggaaattccatatttgactgtcccgtacaaagccaaacttcacctattaatatattattgatccggatcctattatcacctttcaacattacagattgtccggaagtagcagccggtgtttgtatcatcagttcccaatgaccgtttgctaaagcagtcaccttgtatttcttatgatcccatgaagtctttaccaaaatcttttctccgggacgtgcttttccccaaaaacgtactttcgcattttgctgaagtaccatattatttgataatatagaaggaagttgtatatctgcatgaatacctattggaaagaaacagaccaataaccacagacaaaaaataattctacagaatttcattgtattttatagttttagattcaatattttactgaataagcacatgtcaaagataccgcattacatggtagagttaaagaaaaggaatatggagaattcgactttcttatgtaaattcatatgtgtacagcccatcacacgcctattttgtacgattttacaggctatgtacgattttccagtctttctacccttcttttttaattcactttatttatctcaacctttctcataaccaatgcatcaataatatcttcatctatcttcacatcttttttagccgtaatagtcaaattgtcaaaacagaaattggataatttatattgttttgatttctctacagcaaaaaaggaatcacaatccagatgaatattacgcattgtaatatagctggaatacgagactggcatatccttgcgatctttcaaatcataaaactgtgtccaaggagcaataaagatacaattgcggacatttccttttatgtcttcaacgaggatgtacttatattgttggggagtatccggacgcattttcaaccacaacaggcgtttagcctggtccagattgcagcgtcgaagaattatattatgattatatatcgattcgctaccgcaagtcagcactccgtgacagaatccaaaagtacagtcttcaataataatatcacaattgccaccattatcgggattttgatcagcccatggtcctttgccgccttttaatgcaattgcgtcatcattaaccgacatatagcatcccttgacaagtacatttttacatgcatcaatatcgattgcatccgtacttggagcctttacaggagaagaaggtgaaaagatatgcaaatccaaaagttttacgctatcacacttataaatgtgagttgtccaaaacggagaattaacaagtcgcacatctgaaacttgtacattattgctatgagatatatgaagtagacgaggacgcaattcatccatattagtacatttaggaataacacgccgccgcaaccaaaatgacttccaatatcgttcaccgtttccatcaacttttccttttccggaaagggtgaaaccatctaccttatcaacattaatcaaagctgaaaagtactttaggttctgtccctccatccgtgtttctattacaggaaagttgctaatatcgtcactaccttttaatatagctttctcttccaaatgcaagtgtgttcccggcttaaagaacagcgcaccactaagataagtaccttcaggtataacaatgactccgcctccattattagacgccaaatctataacagcctgaattttctctgtctgtaacagtgtactatcattcactactccatagtcggtaatcaagaaactctttcctaatccatttatatcagttttttcatttttgtaaaaccaatccggtataattttaccatcgggaaatttttcctgactaaacagttgcagactgcaacatgtcgctactattaaaaatgctgactttatcattttctatatctcgttacttttttgcaaaagtaccgcatgtttccatttgccccaaagcaaaggatatggagatattgattttcttatggagttctatacaaaggattcaaatactatttatctatatacaatattccatattcagacttatttttgtacatatatcgaattaaaataaaacgctctctacagtatcaaaaaagcgcatcctctttataaattttgtaaacacaatctctcctttacgtccgccaccacgaagaaagatttcataagtactatttcctgattcttttattttcagcagatccaaatccgtattctttgtttgttccccgcgtataaccgtttttaatacccctcctgttgtccggtccagttccactctttgacattttaaacacccggctccaagtagtacttcccgcagtataatgttccattatctctgcttccgtcactcgatatgtaccttgccggatatatacagtatctcctgccatcacttttgattgtgctttacccaacgtggcaaaaggcttatcaatcgtcccactgtttgaatcgcttccattagtagccacaaaataattcgtagccgaaagagaaaagaggaaacatcctataaaaaaaagaagaaggctaatacgtttcattgtatattaagtattatgtagcagcaaagctactgttttttataccataggagctgtaatatcgtacgtaaagaatagaattttgtcttttctacttcaattatcagacaaattccagcattaacaatcatagttcataataacaatagtttgatataaggataaaaatgcatcctttatatacaaatttgcaggtgaatactctcccaatccacttcctttgtagaaagaaaatattcaatctttataacaatataattatgaaaaacttattttatgcgcttacattttttagttttgtcacagcttgtagtgataattcagtccaaaatccaacaccacctcccgtgtctgataatggtgataacaataatatgcaagttgttgagtttctaagaaatcgtgctatggtggcaagttataacactatctttcctaataaagaaacagaaagaatagaaagaaaaggcgtactactcagctggagatggctttccaccgatccggacgatattggttttgatatctaccgcaaagaaggtaactataaattccaaaagctaaacaaaactccgattatcaatagttctaattacaaagatttaacagcaaacattaataagattctcaaatacgaagttcgacaagcaaataccaataatattttatgttcatgtaactttactccggaaatggcacagaacttttaccggacggtcccattaaacaataataatctgccatatcccgatttagtatataaagcttcggatgcagctattggcgatttagacggcgacggagattatgaattggttctgaaacgtgaagtgtcacctcttgacaatggtagcacgggaattggaattactcccggaagttgcctgttagaagcatacaagctaacaaccgggacatttttatggcgtatcgatttaggctctaatatccggcaaggtattcattatactcccttcattgtatatgacctgaatggagatggcaaggcggagatcgcagtccgcacctccgaaggtaccgttttcggggacggaacgaaaataggcgatgtcaaccaagatggaataaccgactatgtagacagggctccccaaagtgccacttatggcagaattatcacagggccggaattcttatctatcattgaaggcagaaccggaaaggaagtagcccgaaccgactatatctaccgtggtgaaaaaaataaatgggtgacatattggggagataattgggcaaacaggatggatcgttttctgatgggagtcggacacttcagatctcaaaaaggaattccaagcctactcatgtgcagaggatattataagaactaccagattgtagctttagattttactgataacaaaataacagagcgatggcattttgatacagctgacaactattcggattatatagggcaaggtaatcataatttagcagtcggagatatagatgatgacggaaaagacgaagtcttatatggggcatgtgtcatagaccataacggtaaagggctatatagcacaaaattaggacatggtgatgccatgcatttgggcaaatttgatcctacacaggaagggtatcaagtagtagtctgccatgaagaacccaaggagtatggaaatattggaacagaattccgggatgccagaacgggcaggatattacattatattcccggaaacggcaaggacgtaggacgttgtatggtcgcagatgttgatccggacagtcccggatgtgaatattggtcgtcagaaccggacggtgtcatgtattcctgcaaaggaaatgaactgacaggtaaaagggcacctatagccaaaggtggtgatacatcatacaatatgacaatctggtggagtggatcattaaacaggcaaatgcttgattacctcgttattcacagctataccgacggacgtttgttcaatggcagcgattggggtgtaaaaacagccagcggaaccaaaaacaatgcctgtttttatggcgatatttggggagactggcgggaagaagttatcttcgttgatgaaaatgatacagagctaagaatctttactactgattttgaaaccgactatcgtttccatcctctaatggacgaccatttatatcgtttaagcgctacacatcagaacataggttacaaccagcccactcatccgggttactatatcggttctgacttgaacaaataaaaaagaaaggcgtgtatgctttccgcaaagaacatacacgctttttataaaactaaccctattcaaaactctatcatttccttacctcaataaatatcagaaagcaaatacatatcgggagcttactccaggtctgtcgtatttcaatccatcaactttggtacttccactgcttgtcaactgtactccaaatatacttgtattattacgctctgtagacgaccaataatacatgtcatttttcagtccgtcactacctgttatttttcccaactgcgtattcatcgtttcccaattagttaccattgccctcaaatcaccgacagaaggaataaaccaaccggaagaaatactcggagcaaccaaattatagttattcaaggaattcactaaaagtgacttattctttgcttccgcatattttttaattacttccgtgtgattataccctaatcgctgatccctcgacgtaccattcaatgttccggtagacgccgatccatcccatcccatcggacttaaatcaatataggaatttctttcggcaaactctgtacgataccaaactcttatttcatctttctccccaaaaacaatattggtattctctttcagccccaaaaccaatccatgggtacagcccggatgatcacgcaataatgcatcctgacgttcagaataagtaaattcattatcttctgtaaaaggatataacacagaaggcatcggattaccaacaaaataaacgactcctacacaatcatcgctaacaggagcattatcgtcaacagaagccaacgcgccattagaatatatcagatcacccactttcaactcatgatccacagtttgcagtcctccgtctatctcacaataaatatactctccggctttcaactttgtcgcatctatcgagtattttttaagcccgttgtctactgaactgataaaacttcctcctatttgctctactttttttgtcggatttaccaaaacacggtaagtcgttgtttccttatcataataaggaatgatcacctgctcaccaatagaaaatttcacctctctcaaagatacactgtaagatggcagttcaggagaaacctcattagtgaaattataagtaacagaaggcagttcggctaccatcaaggccatccgatgattcattacaaaagttattgtacttccgtctgctgaagcctcccctgtcattaaatcattatttgtatatctgtcaccactcagatctgtgtcaacagtccagttccccacaatcgtttcaaacggatcctccttcgtcatatctatagttatattttccttataaggataatacgcataaaaagtcacggtttccaaatcttccgtacacgaaagacgtcctccgtcaattccccatattccatcattatacgtcgcaaggacatttttaatgaaaacttccttatcactatttaccgcaaaaataccaatcgcatccccgtccgaaaaagttgtcttgtaagtcacatcagtgacagcacgacttacattgccattttgttgaatactggaatcaaccacctcaatctttaatatattactattgacggccagcttggcatcctcatcctgcgaacatgccaccatcagaaaagaaccgagcaatacataaattacaaaaatgaatttacaatatctcataatatttcttcttttaaatgtttaattatcatataactccatacttattgacctgcccccctgactcacaatagtttgagtatttcccccatcccattgtacatctcctggttcaactcctgtaatagtattaccgtcacttgtattaatttcctgacgatctccttcaacccatccctgaacttctccagattcgacagttacataaatcgtttcatccctctcactgattattacagtgtacggatgtatgtgtccgggaaccaggtccatctcaccaatcttcttgataaaagatttcccgcccatttctatctcaaaagtaacctctgaaactttttgaggaaatacaatcaatgaagtccgcatattttcaccggccataaccttctgagataacgccaaagccggtgcatcttcgacaacagcggtcgtgccgtctattgtattgaaagttcctttaagtttcaagccaatcaacgtataagttatgtcatccaacgtcaaaccgtcttttccttcaaaagaaaaatcaatcctgctcatctgatgcgaaaaagcaaagttgacatccggattgttccgtccggcttccgtagtcgcataaagaaaatcaatggacatttgcttttcctgtgtttgtttatccgaagtcgtttccactgttatacaatcggcaaccataacggaagtctccgtaaatggataataggcggacaatacatgttcctgttttcccaggaaataaatagactgattctcgtcaaatgctgcaaacgaagataaatttcctgtatatttataggaaatatttacatcatcttcacaagttacccctatacgatcaccatcagtccacgtagtaccaacagtccgggacttctccacaacctccgtgattgttcccgagattgccgctttcaccccgacgatatcatcgccggagtaatcatagctgctacatccccaacataagatagacaatgcagcaataaatggcatttttcttttcataatactataatttaacaagttatattttcggaataaagactgttattgtaatgttacgctcatcaatccaatcactacatcattagcaacggtttccaatgtcagttctttcagagtcttattcttgtccaacggaatatccagcatgacaccggcgccaccttcaaatctgcggtcggcagatccgcgaagtttcaaagcctttcccaaatcacgactcacgattcctgtttttaaatgaaaccgatacgggcgaggtctgggagcatcaaaagcaaaatcatccagataaaagtcctgctcaatcggacaccaattatcagggtttaccaattccagcacctctgaagttccatctgtataatatacacgtacaattccgttggctatccggcactgcatatgattggtgctccctacaagcaacaaataagcatgggaagcttttccagagagaggaaccttcaccatatccggataattatcccataaagaagtgtaagcgatattgttaccttctttcattacacggaaaggaataccaagtgaagttttatacatattatccttcaccaagctacgtaagccggaatcatcaatttcagcagtcagcaatggatggcaccattctccaattccctgagtcggtaactgcaaagttgtataaggagaacgtggagataaatactcatttttaaaaatatccgctacagaagaattaaactgcttatccatgtttaccacacgacatttaccagtttcaatattttcaaatccattgtatacgacttgaggaacattgacatagacattgacaggttgccaccattccatattcccttgacgagtgtacacaaagaaagtatgatgtcctttcttatctttattcactttcgacgaaagcttggttgtgtttaccttcttcgttaccagaacattttgcgggtcatatactttaagaaacgaaataccctgaggagcgttcaagtctacctgtccttccagcgtagtaacaatttcatcatttgcaatctgttgtaagacattaccttcccattgaatctcgatttcagctttggtgacagccggtacagaaacaacaatcagaggatacccattcgcagcttcttccgtcttccatttcacagcttttccattcacctttaccaaacggatcttatccttcactgcattcacttgcaacgtcaaggccaatggttctttgaaacgttgtgtcacattataaatatccatatcacccttacgtaagaattcataagctaaatcagccattgacatagacgccttatcccacgccataggaaatcccgggcggatcaccaattttccattcagagcatccggcgaaacgccatacaagccctgtatcaaagtgcgggatgttatacctatttggtctgcaaaatcacggtaagtttcccggcgaacagcatcatacaaacttatttgtccgaaattgccaggacttttcccaaggtacatcccatccagaatagaacctttcaacaaattaaaaccatcgtctccacgccctgcctgaaaaaaagcaagcgcagtatgcatcacctcggcaaacgccacattattcacactccacacataaggcatccagttcgtagtggataatgtttcataatcacgatccaacccatctgcaaataccggaatatgcggaatagaggtatcgacataccgggttgcctgataagcctggaaaggatcggctgtttcactatctatcgcgtgatagatagtccacaaaccagcgctttcatgtaaacgcttatgccccatgaaatcttgaaactcggcccaatgccctttatcttttatccaaagcctttcattcatcgctttcaatatcttatccgcctctttttcatagggagtagcatcttcccctatcttttcagccagcatagcggccaatttattagcacgatagttatacgctgacgaatgagttacagctccactgttataataaagtgcatcactggcccaaatacagcaataagcatcatacagcccgtcattatcagggtcataattcaatttttcccatgccagatgactagtcaatacaagccatattttacgtacatagtccaaatcgccggtccagttgaaatgccagagcaactcatcaatgtagcaaagattcatatcataatgatgcatttgatcctttcggtaaggagtacggcaaatatacccgttactgtaatgcggggtaccccatttttttaccgaacgtgccaaatgtaaagcagtatcctgtgtaggatgaggtattgtcgcagggacatccgtaacctgacttgctgcatacgaatcgaaatgcgtacgagccctatcatgccagccaataaaatcaccgatataagcagcacgccagccatttaattgcgaacgccagccaatagcgccgtgaagccatattttgccatcccatattccatcagcggcagccgccaaagcccctcccaatggattaaaatagggatccggagtagaaatctgaagagatgactctatctccgaacgccacttttcagacttatcgtatagggaagttccttcaacaagagctggtaaacgtaactcctgatcttccacaacaatataagcagtcgttccatccaaactcaatttataatgtttctgttctttcggaagttggggagcatcaaaactatcagcacgatcagcacccatatcaccattgcggcttaaattcttcgctctaatctctgaaatatagcaatgtaaaagagccccctccggcatatccttcattgtaaaccgccatatccctccttctgcgtcaggaaatgccagtacggagatatttaattcacctttgcccaacaaaggatctgtcagacgataagtacgccttcccgccctgtatctggcctcacaaaattttaaagaatcaagggctatactttgattaccacattgcaagcgaaaacagatatgcttactatccttcggcttataagcagcaaacacaggccggtcgctcgtttcaatcctaaagtctgtaatacctccgtacaatgcacgagtatagcgattcttgccgttcacacaaacaaaatcattaccatccggacgatattgtatagtacgttttatcccttttttacgttcaatttgggaaattgtctttgttatatgcgccccatctgtcgctgcttgtacaacaagtgagaacgcagagcacatcagaaaaccaatcaaacaacttttattcatattttcctatcctatatttattacatttacttcaatttttaacgatacgcttcattttgtacatacagcccctctttcactttcatctgcgaatcgggaataggatagagataagttccatcctttatttgccggatatacaataacaaagtcggacgtatgacattaccattggcatccactgcatattcctgaaatttatcacgaacagcttgaagattattatgacgtaccaaatcatgccaacggattccttcacaagccaactctctccgtctctccttgtcaacacattcccggaatgcagccggttccttttcggcatttgtcaataccggtattcctgcacgccgccgtatcctgtcgaccatatcaaccccttttgaagttggacctacaatctcggcatacatcaacatcacatcttccaaacgaatcaacgggaaattcagagggaaataagtacgatccactatctgcgcattaatatcatcataccccaatgcttctcttttcattttatgttccaggaatttgataaagaaatcctcacctgcatatttcgtcacactattaggattgtcatcattcacaaacttggtcgtatcaatagtagccagacaccgtacatcaagaaaatgtccttcttcatcttgttcctctttcaataaattatcaagccccttcgcacaagcaatactattaccggacatttcaagagtaacatatttcgaaggtaaacgaggcacggagtgaaataccatcggattaccataatctttagcgactatatattgaatttcaaagatgtgatatttattatcattctcatttatccacattctttgccattcacttgcatttttagcccaaaatttaccggttgcatccgcataatcaattacttcttcaagaagctccctagcgagttcctttttagtttcatcatacagaggaaatcccgccattgtcagataaactcttcctaacaatgcctttgccgcagtcaatgttgcacggccactggcggatttccttcctagataatccttcggttcctccgtcaggcttccgacagcatattccaaatcaggaataataaccttctcataaatttctacagcctccgactgcggagtcgacattgcttctgaaatagtctgaggaacaagcgtcaaaggaacacgcccgtaataacgaaccaaatcaaaataagctaatgctctcaaaaaacgcgcttctcctatttgttgttcctttattccttcaatagtataattcaccccatctaccttggacaaaaacaaattggcacgcgaaacaatctcaaacaagtcattccatgcatcccgaactgttgcaatggtcgatatattaggattaaaagaactgatgtccatatagtcacgctgtgccgtactcagttctccgcaccatgtattatccgaacgaacctctgacataagtaaagcataagtcgacaacggaagcagtccgttatatactcctatcaacgcttgctccatttgcgacggggtcgtataaaagttttcagtagtacgggtatctaccggagtgacatctagccagtcactacaagaagagaataacaatcccatactcatagctccacttagtatatattgatatagtttcatagtttcttttattagaatgttacatttacccctaaagtaatagttctagcctgcggatatgaaccgtaatcatagtcactattctttccgtcattatttacttccggagaataaccaccttcatatttatcccacatcagaagattttctcccgaaatataaacacgggcataattaattatcttcttatttttgatgggaatacgatagcccagcgttacgtttttaattttaataaaatcggtactatacaaccagcgggtatcgtacagtgaacctgtattagagttattaataccgggagttttcccatcacccggctgttcctcggaaacccacatatttttccaacgtgacaatacattgatagatgctcccatacccggacgatccatgccacgaccgagcagactatatatcattccccctgtctgtccagtcagtaatacagacaggtcgaaatctttatatttaaaggtatttgtcataccaaaagtataatcgggatccggtttaccaaccaacgtacgatcctggtcattaatcttaccgtcatcattcacatcacggtatctcacatcaccctggatagaattggacattgtaggatatttcctcaaatcttccttatactgatacactcctacagcatcatacatataatatgccctcaaaggttgtccaaccatcaatacctgtgtattcgatttatcccatccaatgaaaaccgtactattatcttctcccaaactcaacaccttattcttattataagctatattcaaagaagtagtccacttgaaccttcctgtcaatttttgggtagtcagttcaatctcaaaccctttattttttatactaccgatattcccccatgcttgtgtgaatcccattgtaccaggaacagaaacctgatataataaatctttagtcgttttatcataataatcggcagcaagagttatcctgttatcaaaaaatcccaaatccaaaccaacattccaactgtgtgtcttttcccatccaagttctttattatcaattgaactgggagcaaaaccattggtcaggcttccaccaattgaatagttggaactacccatcagcccgatagcagcgttagtagaaatagaattatttccattcataccccagctaccgcgtattttcatttgattgaccacaaacttttccggccaaaacttctcgttagagattcgataggcagcagaaacagcaggaaacatcccccaacgattattctttccgaaacgtgaagaaccgtcgcgacgaatacttgctgtcaacaggtaacggttatcatattcatactgggcacgcccgaaataggataataagcgattgggagttgacaaggtagctaacgcaacttttatagcctcatcactttggttgaaaacttcaagtgaattatccgggaactgttgcgcagacaagtttgtagtggctcccgaagaactttccattgaataacctgccatagcggcaatattatgcttgcctaatttcttatcataatttaatacagcctgcaacagatatttggatgaccgtatatctatacggttggcagaactatgatacccttcaccatccgtccagttcttaattaccgaactcggagtaaaagtgcgagtctgacggcttgtaaaatcatacgcacctttcacttccgccctcaatccgtcaataatattgactctgataaaagctgaagaattcaaccgggccgtttcgatatgattggtgacctgctccatataagcaatagggctgatttttgtactagaccataaataagaggcataaggttccgcaccggaatatatcccagcatctggctctgcaactggacacattgtcaaaacctgatttgcctgctgatctttgccatccacacgcccaccatctttccagtccattgacggagccatattaacgcctaaagtgatgcgatcatacaattttgtctccacattagcccgcagattcaaacgtttgtaagcactctctatagcaataccttgctggtctatatatcccagagaaagccggtattgagtattccctctaccatttgaaacagaaagctgataattctgcatcggagccaaacgataaaattcatcctgccagtcaattagtcttaatccaccgtaaccgggctgtgtccatcgcgggtcattcatatactcatagtttacccgattaccattcaaggcataacgggtatcccaatcatcatctgccgtagctccttttcctcctaaagcagcaaggtatctactattgttataggcagtccggaaagtgatccactcttccgggcttagtacatctattttcttttccaattgttggatactgaatgcagcagaaaactgtacccggactttatcatccttattagccattttagttgtaatcaaaacaacaccattagcaccacgagaaccgtaaatagcagaagatgaagcgtctttcaaaacttcaatcgactgaatatcatttgggttgatacttcccaaatcatctatcggaattccatctactacatataaaggagtggcatccgcattaatggaagcagctccgcgcacacgaatctgtaattctgatcccggcgcaccattagttgaccgtacttctactcccgccaactgcccctgcaatgaagaggcaagattgggtgccggacggtcttcaagtttcgctgcatcaactttggcaatggccccggtcacattcccccttttggctgtaccataaccgattacaaccacttcgtccatttgcacgtcattttcgctcatcctgatggcaaaaacactctttcctttaatagaaatagtctgtgaagcatatcccaaataagacacctcaattgtcttagctttatcaggaactgcaagagtaaatttgccatccacattggtaattgtcattccagacttcccttctgctacaatagttgccccgatcaacggttcatttcgttcatcaaccaccgtaccggatatggtacgtttttgtgcaaatactgtgaccgaatggagagccgaaatcatcatcaagaagaaaaatatatattttcttctccaacagctaatctcacaaacagtgcttttcatacattctagttttcatttaataatattagttttatacaatctcataaaccatggtaatacaaaatccagttatcaattcaacagcaaatatagcggcatacatgaagctgctcatgcatttttctccatataccatgcacatttgtccacctgaacattcttatatagtccctctttctttttttcaggttattcaagaaattcaatgcaaaagtctgaatttaaactttaaaattacgtgctatttatctatctttaccgcaaatctaaaaaaacacaatcattattatcactatacaagtatgagattcttcattaaagctacaattttcttttttatatgtacatgtattatatatccggcaaacgcctccatagaaatacatgctaggaatctgactgccactgacggattagccaataattctatcaggcatatctatcaagacagcaaaggattcatttggttttctactttaaatggcctgagccgttatgatggaaattcatttgttactttccgtccccagagcggtgaagaactgtcattagcggatcatcgtatcagaagtgtacaggaagactccgacggattcctatggattacaacttccgcggaacaaatcagttgttatgatttaaaaaaagactgttttgtagatttcaccggcaaaggagaaatgaaagaccgttataatgaagtcacaatcctccctaataaggatatatggctttggggaagggtgcaaggctgccggaaaattacttataaaaacaacaaattcagttcggaaacatattctaccgacaaccataaactaaaatccgacaatatacgttttcttagtgtatttgattcaaattccatttggattggtacaggaaaagggctgtatttacttaaagataacacgctcgaatgtatagattcgactcactacttccttcaaagcgcagtcattgataatactatttatttcataacatcagagggatttatttggaaatacaaccagcagcacctcacgaaagttgccaatactgccacatcaactgattttttgctaacaggcaatattgtattacgtaacgaatggctgttatttaccaaacaaggcggaatcttattcaatcccaagaccaatacaaccagaattgctccggaagagctcaatatccgtaatggattggtagtgaaagataaccgcaacaactactgggttcataatcagactggatacattaactatattcaaaaagaatccggtagtgtcaaaaagattgatgtaagatcgtcaaagcttccatatttcattgattacgaacgctatcatgtctatcatgactccagagacattatatggataacgacttatgggaacggactttttgcctataatcctactactaaagaactggaacattttaccgcaaccgccaatcatacaaatcccatcgcctcaaactatcttcaatatataatagaagatcactcgggcaatttatggacaagtagcgaatattccggtatatcccaaattgaaatcataaataaaggggctgcaaaagtatatcccgaaggtgaattaaatatcgacagggcaaatgccatccgcttcatatcccacatgcaagatgacgaagtatggataacaacgcgtgcaggcggattatatatctacgataataaactaacaaaacagaaaagcaaaaagtattatgatataaatatctattctgcatgtgaggatagtaaaggtaatatatggttgggaacacgcgggaaagggctccaagtcggagacgaccaacactatatacatcaggcaaccgatacaaattccttagctgccgatccagtattctgcattttgcaagaccgcaaacaacgtatgtggataggaacgttcggcggaggacttgatctcgctgttcctaaaaaagacaaatacatattccggcattttttcaataagacttatggccaaaaggaaatccgcactatctgcgaagaccgtaacggatggatatgggtaggaaccagtgaaggtgtttttgtattcgatcctgaccgtattataaaagacccgaacgatttttaccaatacaatctggataaccatgccctgaaaagcaatgaaataaaatcaattatacaagataagaaaggcaggatatggattgccgaatcaggtatcggattttgcgtagccaatataaagaatgattataaagatatatcctttactcactatacggtcaatgatggacttgtccacagtgtagtacaagctttcattgaagatgatgaaggaaatatctgggtatccaccgaatatgggatttcttgttttaacccggaaaacaaaatattcaacaattacttcttttctaatgatatattggggaatgtatatacagaaggatgtgccaaattaaaagatggtcgtttggctttcggcaccaaccacggacttataatactcaatactaagcaaattaaaaacaaagagaaaattctgtccgttacatttacagacttaaagttaaacggaatatcagtccgtcctgccgatatggactctccattgacagccgctctggcatatacagatgccatcagtctgaaatattaccaaagttcctttgtcatagacttctccacttttgactatccaatttcgactaatacaaggttcagctacaaacttgaaggatatgacgatgactggagtattccttctacattaaactttgcagcttataaaaacttaccggcaggtacctactatctacatgtcaaagcctgcagcgtatcaggtatatggagtgataacgaggagacacttgaaatcaaagtaactccccctttttgggcaaccggatgggctttctttgtttacatactcattgcaggcattatcatgtattttgtatatcgtactatcaggaatattaacaacttgcggaataaaattaaagtagaaaagcaattaacagaatacaagttagtatttttcaccaatatctcacatgaattcagaactccgcttacactaatacaaggggctttggacagaatccaccgtacccacaatatccccaaggagatacgttactctatcaaactaatggacaaaagtacccagcgtatgctgcgtctgatcaaccaattacttgaattccggaaaatgcagaacaacaaactcgccctttcacttgaagaaactgacgttatcgctttcttatatgaaatctacctaagctttcaggatacagccgaatccaagaatatggatttcaaatttataccatccgtcaattcatacaaaatgtatattgataaaggtaatatcgacaaaatcgcctacaatcttttatcaaatgctttcaaatatactccttccggtggaaagatagaattcagcatttatattgataaacagaaacagctattaatcatgaaagtaacggatacaggtgtaggcatacccaaagaaaaacgtaatgagctgtttaaacgtttcatgcaaagcagtttttctagcgacagtataggagtaggtttacatcttacccatgaactggttcatgttcacaaagggaacatctgctatgaagaaaatccgtcaggtggttctattttcattgtaactttacctactgattcttccatttatcaatctaacgacttccttattcctgaaaatgccatattaaaagaagaagcacaaaaccatccttcgctttctgctcttaatgaggaaaatgctcactctgaatcagaagaagaaatagataaagaagtagaaaatatagagaaagaactaaaaacagaactgaacgcatctgatcaagagggtcctctaaacaaacggaaaatacttattatcgaggatgacaatgacgtacgggaattcttgaaagaagaactgaccccatatttcgaggttgctgccgaagcggatggaaaaaatggtctggagtatgcccataataatgatatagacctcattatcagcgatgtcatgatgcctggatataatggtttcgagataacccgtaaactaaaaagtgactttagtaccagtcatattcctataatcctacttacagccctgaatgcagcggaaagccatctggaaggagtgaaaagcggtgcagactcttacataacaaaacctttcagtaccaaactgttactggcaagcatattcaaactgatagaacagcgtgacaaactaaaggagaagttttccaatgacttgtcagccaaacgtcctgtgatgtgtacatcggataaagacaaggagtttgtcgaaaatctgaccaagatagtggaagaacaactgactaaccctgaatttactgccgatgattttgcttctatgatgtcactgggtcgcaccatcttttaccgtaaagtgcgtggagtgaccggatatactcccaaagaatatcttcgtatcatgcgaatgaagaaagctgctgaattgttgtcaaccaagaaatataccgtatctgaagtaacttatatggtcggcatcaatgacccgttctatttcagcagatgttttaaggctcaatttggcatctctccttccagttatcagaaaagataccaagagggcataagagaaacagaaataaacgaagattaataaatatatttatgtgtttgtgaacatatgtacatgtttaatggaattttttcactagtcggaataaaaagttcagactaattttgtctcagaaaaaattatcaacacatttaattatagcattatgaaaagatcagtattaattttaagcctggcagcctttgtattatcaagcaacgcacaagtattaaaaagcaatctgctaaatggatataaacaaggtgataaattggaaaaagctacatataataaagctgatgctccgataaaaatagatacctggtgtgaagcattctcttcccaaactgacaagaatgccggtagtcccattaccggacaagagctcagttatgagggatatacggaaaaaggagtatctatcaaaataggagaactcccggaaaatgtgaaaggttcaagatttagcgtatattccatttctgaaaagaatgactattgcaggggaactttatacctttcatttttggcaaacttttcctccgtcgcttccagtcgcttaggcgatttcattgctctttcccctgttcatactggcggtaatctgcgtgccagagtatatgtcggtaagatagacgatgaacatatccgattcgggactaatctgttaagagttaatgcagaatccttcaaaagccatgcgcttaataagacgcatctattggttctcaaactggattataaaaagaacgaggtttcattatttgtagacccagccttaacagcagaagaacctcaacccgatgtggtagcgaagggggacgaagataataacaaattaaaaggggggattcgttctatttcatttaggaaccgcgatgatttgaccggaaatgtcggtaacttccgcttctcttccagttgggcaggtgtgatagctcaataaaaatctatttttattattgcattatgatgtaatatggagcattgaattgtgtacaatgctccattgtttttacaatcatgtcacttaaattcacttctgtcattttacatcataataagtattatcctcctccttcacataaagaaaaaaaatgacttatctttaatagacaagctttctgtttttaataaactattgaggagtttattaaaaacggtatccaagtttattataaattataaatttcgattttaaggttctccctgtactttttcataacaaaaaagactgcgaaccttataaagatttgcagcctttagcttatacggtaactctcacagcttaactattgtaaggagcttctgatatattgttataatattgtactattctattttcattcttttttaaattctttatccattaatctttccgcttgcaaatatacaaaattaaaaaggctttgtcaagagtgcgctactataagaaaaagtatttgtaacaaagttccatatctaataccttacaaccataatatcgctatttgtggataaaactacatacaaaatggaattttttcatcatagctatttgcagaatcaacctaattttgtcatacaggtctaaaagaattattaatcatatataaatatcacagaaattatgaaacacatccttttttatgcattattctttattttaaagattgcgtcggcacaagcccaaagtcttgaccagccgaagaactatccagcagatgctatttcttcttttgctgaacgtttggaacctatgggacgcatcttggaagacgataattattatgtgtggtgttgtgcaccaattatagatgaaaagaataaagtacatgtattttattcacgttgggaaaaaaagtatgaaatgaaaggatggctggggcattgtgaaatcgcacacgccgtagccgaccaaccggaaggcccatacaaatatgtatcaacagtactgtccccccgcccgggctattttgatggtaatacatgtcacaatccaagcatttataaaatagacggtcgttactggctattttacatgggagcaaccaatggtaaatttggaacgaaacgtatcggatacgctgtagcaaactctatttggggaccgtgggaaagatgcgaaaaaccattattaatgcctggaaatacaggtgaatgggatgattatattaccactaatccagctttcttaaaacatccggacggaaaatactggctttattataaatcttgtaatgaaaatgaatatgtgaaccaacatatcaatggtatttcaggtaaccggaaatatggggtagcttttgcagataaaatcacaggaccttatcgacgatatgaaaaaaatccgatcgtcgatttctccggtttcggagaaaacaggcaagtagaagatgcgtatatctggtatgaaaacggtatattcaaaatgttaatgagagatatggggttctacgaccatacagtggggctctatttcgaatccaaagacgggctgaactggcaaaaccctcaaattggttggtttggagcagagcattatatcaaacaaccacccgctcctaaacatctcaaacgttatggacgtttcgaacgcccgcaagtactaatgaaaaatggaaaaccggcttaccttttcacggcttcccaagggggaaaagcagaaacatcttcaggtttcgtctttaaaatcaagcccgaataaacgaacatagaacttaaagtacacttataaaaaactgttatgaaaaaaattatattgatattatttaccttgttgcaattcccggcaaacgcaaaagacttgcctcactcctcctattggcacggagaagaaagaactcttcgatataaacccgaaggagaagagtttgtaataaccaatggaaataaaagatttactagagctatttatggaactaataccggctttcgttttgaaaccagtgacttccccgaattcggactttacatgcctaacctcggtggaagtgtatatatggctatatctaccccctcaaatattacttggataaaagatatggaattcattgaatctcgttttaaatccgggcaacgcacctacattgtgagagacaggagacatctaggaaacggcagtctgacaattgatgctgtagctatgtccgatggcgatggattagtagtaagatacaaagccaaagacatccctgccggcactaaaatcttgtggatatatggggggagccaacaatcagaaattcggacgtgagggagacttgaattccgacccagccgattgttttttcattaaagccaacaattgttccggaaatatatatcaaattaatcaaaacaaatttacgatacaatacgggcaccacaccagcaacagagcctctcaacataaagtaatgtccatagcaggaacctttcctatcggaactgatataaaagaagtggatggaaaccttattgaccaattggacgaacttatcacatcccgcaaatcaaacaaaccggttatcatagcaaaatatccggttagtaccattcctttctatattgaactgcacaaccctaaaagtcatagtgagtttcaatataatgatctcagtaatgttttcaacaaaggtgttgagttcagaacccaaatagcttccagaatcaaaataaaaacacctgatccatttctgaacacattaggaggcaccttctctggagcggaagatgctgtatggcaatctccatcgtatctacatggagccatctgtttccgcgaattacttcttaccggttggagaggggcttatctcgcagacttgatgggattagaagatagggcaaaaactcactttaacggttatcttaattcgcaagttatagatgttcccgtcacattaccccatcttcaggacacagccctaaacctcgcacggtctgcaaaaatatggggaacccccatgtatagtaatggttatataggaagagttcctaatagaagagacgtcatgcatcattatgatatgaatctagtctttatagaccaactgttgtggcatctcaaatggaccggagatcttgattacgcacgagaaatatatcctgccctccaacgtcactttacatgggaaaaaaaactattcgaccccgataacgacgggttatatgatgcctatgcttgtatctgggcttcagacgcattacaatacaatggcggtaaagtgacacattctactgcatataactaccgggcaaataaaataatggcagaaatatccgaaaaattaggaaaagatccaagcatatacaaaaaagaagcagaacttatattatctgccataaacaaagaattatggataaaagacaaaggatggtgggcggagtttaaagataatatgggaaaccggatacgacatgacaacgctgccatatggactatttatcatgcaatagattctgatatacatgatcccttcaaggcatatcaggcaacccgatatatagatacggaaatcccccacatccccgtcatgggaaaaggtttgaaggatactgccaattatgtgatttcaacaacaaactggcaaccttatatgtggtctatcaacaatgtcgctttcggagaaatctcacataccgcccttgcttattggcaaacaggacgttatgaagaggctttcaaaatgttcaaaggagctgttctggatgcgatgtaccttggttcaggtccgggaaatgtcacacaattgtcattctatgacgcagcccgcagagagacatatcgtgattttgccgatggaatagcgacaggggtacgtgctcttgtacagggtatgtacggtatcatgccagatcttattaataatagactaacgataagacccggattccccgatgattggaattttgcagaaattgaaactcaaaatatggcatatacttttgaaaggaaaggcaatatagaaaggtattctataactcctaatttactcaaaaaagatgtcagcttgtcaatggaaataaaagctataagaaacaaaattaaatctatcaaagtaaatggaaaagatacaccctatactttacttacaaccactattttatctccagaaattaagtttgaggcaggaatagctgacaaatacgatatcacgatagaatgggacggagaaaaaataaacagagacatgatatctgtcaatgtagccaatggcagccagttcagactaaatattccttataaatcaggaaaaatatatgacccgcaaaacgttctgcgtcatgcaaacttaaagaatgacatactaaccggcactataaccgctcaaaacggacatcgcactgtatttgtcaatatcaccaatggaaatatgaattattggcttcccatagatataaatgtcaacaatccgcttgatatcgtttgtgattctgaatcttcttctcttatttttaccttgaaaaacaatatggataaagtgataaaaggtgatttgtatatcaatggtaaaaaggtgaatgaaaacatcaatatagaagctcatggaaaaaacaactatgaatttgatattcccattgcatcttcaggaactaatagaataaaagtcaaatccggaaaagacacttactcttttcgagccatcaattggaatatctctgtaccggaaaaatcagtttataagacggtagacatgaagaaaatatttaatgacaaagtaagtaatatattcgcttatggaaaatatatgttcccaagatggaaatacaccacattacaagttccgacccaaggtatgggacaatggtgtcatcctcaaagtatttctgttattgatgaccgtggaataagaaataaggcttcaagaaataacaatagattcattatgccacaaggaatacctttcagtactccaggagaaaaagaatataataatattgcattcaccacattatgggataactacccgacttccattaatataccactaaacggtaaagcttctaaagcctatttcctcattgcagcttccacttattatatgcaatctcatatagtaaatggcgaaatcaaaatagaatatacagatggacaaaaagaagtactgaaacttatattaccagataatttaattcctttagatcaggatatattcgtagatggatatgctttcaacactaaagatccacgtccgtggagagtacgccttaaaacaggtgatgtaagcaaatatcatgcaggcgaacttggaaaaacaatatcgaacaacccgatatctattgatggtggtatggctacaatgcttgatctgccactcaatccagttaaagaattaaaatcattatctttggagacgacagccaatgaagtcgtgataggattgatgggagtaacgctagtcaaatagccacagaatgagggtgatcaatgatacaccctcattctatatatttctggacactgtccataatattcctactgataactgatttctattttactatcaatattgtattcttgtcttacttgactcttatcttccacttccaaataaatttcacttaatcgaactttttttccatacactatctttcccgctgttttcacttgtgctcgaatattaaatagatagaagttctcaatacgtaaactatcattccaccccgaagctgtaatgaaacatttagatcttttcgctcttacatgagagaaataaacattgcgaaagtgtggataccctttttctttaggttctactggagtcagcattattttccaatgtgcaggaatctccctactttcatattctacaggtaatttcgaataactatattttggatgccagttcaaatccacctccaatacattagatacactatcagcctcaactcctgtgacataaatattctctactgtcccaccacgattcatagacgatttaagccgtaatacagatcctgtgccatacgctatcagatcatgagccagtacattacgaatagaaccggaagtctcacttccgcaagtcagtaaccctgcacctttacgggcaatacagttacgaaccaccacattctccgtgggacgattcacacgcagtccgtcggcgtcacgccctgccttaatacaaatattatcatcgttgcaatccacatcacagttttctaccagaatattggtagatgaatcaatatcaatgccatccgtacttggtccgtgacctcctacattattattaatagtaagtccgctcaccgaacaatgatccgaatacaaaatctgacaagcccagaatcccgtacgcaccaacgtaaagtctttcaacgtgatatgcttgctgttggaaaccagtactcccctcacccgcttgcaatcataatccacaatccaacgcagattcttcttctcatattcctcccgcatcgcccaatatttatcccagaatacttttccgcggcaatcgataaaaccttcccccgtaagagcggcattttccgcatccattatattgataacggccgaaggccatgtcatttcgataccggcaatgcgggaaggaaattccggatagtcctgaatattatcactcgcaagcaaggtagtacctttactaagatgcaggttcacaccactcttgataaacaaagcacctattttataataccccggggcaacaactaccgtacctcctccctgttggtgacaagcatcaatagcggcctggatagcaggagtactgaatacggaagtgtcattccgcaacccgaactttccggcatcccattctgtgttttccggagtcctctgcgcccccacctgatcggcccacgacaaatccggctctgcagatacacttccccaatcataagcaggaatcgtctttttcggagttgtaaaaccaatcaaggccaatagtacaatagataaaagatacttcataattacttcttttagttcacgttgcaaaattatcgcatatcatcaaagaggtaatggacagatgtacgcaaaagatagaatattatatcatacggacaattaacttgaaagggtgcacaattgtatatagtctttgtacatttctccatttcatacatcacaaaaaggagtaattttgcattttgaagttacgaaaagagtgtaatttattggaaatgagcgtaggttaattgctcttgatagtaataggttacgatttagttagttatctactgcattatccttctgcgcgttgcgtaaccttcaaagaactcttcgtatgcaaaagtagctatttaattcgagattttgatataaactcccgttttttatcccctcattcataagaattttccgtaaaagcggtattgtccgtcggcacaccattgcccaaaacgagtttggaacaaacgtgtgccgactaccgcatagctggagaaaagggcattgcctcacgcctaaacgatgtttagacagatgaagcaatgcccctttcttttgcgcctatgccaagaggtgcttttacgggttttcaaatgatttttcttttttcgctgtctcttttgccggaagcggaaagtgaatgcagagtgtgtcagcctgccccatgaatgaaacaggcgcccacacacagccggacaaaccgggaagaatgattgttgccacccggctgaacaagttccgtcggatcggaaacaatcatacttcctttgttgtggtttgcccttttcacgcttccggtgatgtctttttccttttggtgattcttttttttacggattttcccctgaagtttttttctacacaatctgcctctgttttcgtttacctccattttgcgcctttcagtaagccgcatcagtcagtcattttcgttctgggcgcaaaggtaattccgggattggacgggaaagcaaggtcaagcctcctgttttcggtaaaaatctccagccctgcgggtagtattttgaccgaaaaaccttgcattccctaatccctaccttttcaagcacccgaaacgaaaacgaccgatgcgacagaaagacgcataaaaaaaatgtcggataaacgagaggcagataagatagtttgaaactcaactccctcagctcttgaatccgcattaaaaacaaaaaaatcaaaaacagcgaagatatgacggcaacggcaaatttcagacaaatggcgcaacacatcgggttggcgatatgcggcttgatgatgcgcaccgccttcggggtgttcggcatcctttggggcatcatcagagagattgtaaacggagtgttccgagtggcgataggtgtaatcgtggctatcctttccaccattgccttctttggcttcatcctttggttattcaccctttaacccttaccgacatggcaaaaagaaacagcaagacggcagcgcagcagtgcagatattacgaggtggacaacatcttcgtgtatatggtggaaacgtacatcaacggcaattttgaaactttccgaagattgtaccacgaactgaacaaggacgcacggagggatttcatggacttccttctcagcgaggtagagccgacctattggagagagatactgaaacagataatctaaaaatgacagcgatatgaaaggaacagaccatttcaagagaacgatatatatgtacttggaacagcgtgcggaggaagatgcgctatttgcaaagaagtaccgcaaccctgccaagaacatggacgagtgcgtgacccacattctgaactatgtgcagaaaagcggttgcaacggtttcacggacggagagatattcgggcaagccatccactactatgaggaaaacgagatagaggtgggcaaaccgatggactgccaagtggttgtgaaccacgttgtgaaactcacggcagaggaaaaggcggaggcacgtcagaacgctgtccgcaaataccaagaggaggaactccgcaagttgcagaaccgccacagaccgtcagcgagaaaagaaaaccaaccccaaccctcattatttgatttaggcttatgaaaccgaagaccaagatacagaaagaggtggcaagactttccgccaaccttcgccccatatcagcgacacaaatagattgggcataccgccactgcgttgagcatatcggctaccgcaccaagaaagggaacatcacctgttccgactgcggtcacgagtggcacagcgacagcggactatgcgacacccttgaaggctgcacctgccccaaatgccatgccgaactcaaagtgcaggacacacgcagacgcatctacaaggaaacgcagaatttcagcgtgataaccacctgcaaagggtatcaggtaatccgcgtggcgcaggtcagatgcgagagcaggaaaggcgaaccgatgcgtttctactgccacgaggtcgtgcagcgttggatttcacccgacggcaaggttacggacatggcgttgctccgtggcttccttttctgctattgcgatgtgtgggcattaggcagcgatatggaggtaagaccgcacaacagcctatacgatgatgtggtggcaagaagctgtgcatatccaaagatgaggatattgccccaactcagacgtaacggcttcaagggcgatttccacggcatctcccccgtgcgtcttttcaaagccttgctttcagacccaagaattgaaacccttatgaaaggcggtgagattgaggtcatgaaacactttcttttcaatacccgtactgccgatgaatgttgggcatcatatctgattgccaagcgtcacaagtatcagatagacaacctctcaatgtggtgcgactatctgcgtatgctcaaaaaactcggtcaagacctccgtaacccgaagaacatctgtcccgaagatttcatggcggcacacgacaacgcaacccgaaaaattgaagccatacacgagaaggaaagagccgcagagcaacgccgttgggagattgaaaggcgtgagcgtgagcaacagcgacaactccaacgaaagaaagatgcggaggatttcatcgccaacaaatccaaattcttcggcttggtaatcacggacgaggaaataatcgtcaaggtgcttgaaagcatagacgagtattacaacgagggcaagacgcagggcatctgcgtgtttggcagtggatactacaagaaagccgacaccctcatactatcggcaaggattggcgatgagattattgaaaccgtagaggtggacttgcgaaccctcgaagtggtgcagtgccacggcaagcacaaccaggacaccgaatatcacgagcgcatcatagaccttgtgaacaagaacgccaaccttatccgtgagcggatgaaagcggcatagcataacccctaaaacaacattgatatggaagtaagaattgaaagtatgatttgtgtgtgggatgatgcaatccccacgatgttccttgaatttgtgaacctcctcactctcacaacgagtgagggggaattgagaaagagcgtaaaggagtttgccgagaagcacgaacttgacaagtttttcctttacggcttcggctcacaccatttctacctgcaccaacgctacacaagcaaccccgaaatggtgatgaagaacagagttctgtcagtacatttttaaccatctaaaaagcaacattatgacaacacgaatgaccatcaacggagtaagcacctgcgcggaagcaggtacggagaaatacgagcgtttccaatcgggtatcggaagacgcaggcggacacttgtgcagtacgactaccgccaccccatagacagagaattgttctcttgtgtcaaacccacgttggacgagtgccgagccgcacgggacaagtggctgaacgcaaagaagggaaaggaggacagactatgaacacgacctatcaaacgctgatagtcaagttcagcgaacctatcacggcattggacggtatctttgacgataccggagcgtggggaacggacaccctcaaggggtggatagatgattacgaaagcacacgtttcaccgccaccgacagccatacggcagtcatcacgagcgagtacaatatggaatgtgtgaaagagtggctacaacggcagacccccatttccgaaatgcgagaattttgaacgggatggcggtgtccgcaccgccaatacttaaaaccctaaaaacaaaagatatgatagccaagacgatattacagcagataggcggaaaacgcttcaccgccatgacaggtagccgtgatttcatagatatgggcaacggcttacggatgagccttgcaaggaacaaaacaagtgccaaccgccttgacatcatctatgacgaaggggcagacctctacaatatgcgcttctaccgcaggacgttcagcaaaaagacctttgagtgcaagacaaaggacattgccgtacacgagggtatctattttgatatgctggaggaaatgttcacgatggtgacgggactttacacacgcttttgagtggcggggcggcgagagccgccctactttctttcagtgagcatgatggcggacaaagaaagtagcaaagaaacctttgtccaatctgcgataactaaaaaatccgcaagtaaaacttgcggaggctatatattgggtcgttattttttggtggaggggaatgataatctcgaaccgttgaactacacatttctgcttcgtctccatttcccccaacgatttgatacgttcaatcatttttgttgttcctttctgaattttcctaaatactttcttcataatttcgctatactttttatggttaataactatgttttgtattgctctcacaacacttacaacttgaagtgttatttggaaaccgataggcaaaaatggctcaacgatgtcaattaacgagaaaatcctacgataatctatcaagtgatagagcaaaagacgtgccaagttaaatatggcacgtcttttgccagttttgtcagtccttttatgggatatacaacagcgcaaactccgcctttctccgtttgagcagcatggcgtggcgttttcctttgtagttgcagaaggctatatactcacggtagatgttcctgtcaccagcttccagcttcttgattaaggtgcttttggggattgttttgctgcctaacagcttcgccggtcccacattgtaagctaacgtgccaagcaaaatcgaatcaaccccgaatttacggaacatggcgacaaatttgcgcaggtctttccgcaaaagttcatccgcatcccgttttgtcatggttcgtgccgaatacttctcgtttggcaaaagtttgtgaccccaaccgacgtatgggtagtgtttttctgagtgccagccttcaaagtagcggcagcataaaaaagcacgttccataagcggcagtcggtagattgccgcctgcccgtccgttccctcttggcggctgatctgcgcggacacagaacagaccgtcagaagtgaacagagcattgtcatgaatacacgcatcatttcaacaaggggctgaagttgccgatgggaacgatggtaagatcgtcgtcctttacattcctgttgttgaagtcaaattccagttcgtaggagttgctaaagttatcctccaccaccacgatgaaattatgcgcctcatcacccgccgccgtgtagtacaggcggaatttttcgttctccagcaggtagcggtcgttaggcaggaaggtgatgccgttatccattttgagcgagccttccccctcgaactggaaatagcggatggtatagagcgtacccgaaaagtcgccctcctttttcagttcacagcggatttccactgtctgcccctttactaccttgttcggcacgggcatgacctccaccgtgaagggataggactgctggatgtccatgtcatcgtcacatgacacgagggtgaatgacatggcggctatcaggcataacgccactgccttgaatattgatgttctcttgtttctgttgttcagtatgttcattgttcttcgatttttagatggttgtttttctgttttttcgttgtcagttgcaggtactcgttcaagtccttgcaaccgtcatagagggaggaacggtcggtgacacgttccccgtatcgcatggtaagtgcggcaagcgtccgccgtccggcttcgtcacggtcgaggaagcagccgatgcgcccgtatccgtccagcaatcccgccgccttctccacgttggcgactgagttcagcacaagacagtcagcgttaccggttacaccaagcgtcacggcagagagaaagtccatgaagccctcgaacacgaggcactcgtcagccgggatgtcattcgcctttaccagtgatacagacttcggaggtatgcaacccttgaaatatcggcttctgacttcatagccacctgccatgttcggaaagccaacggcaaaataccgtttcccacgcacaccgtagttcaagcggcagcagtgacgggatgcgatggcgtaagggatgccccgttcctctaaatactccgtcagcagtgagcggagcagcggagcgacctccacatcctcaaaaacggattcggtcggcttcgagagatagacgggcttttcccatccggcaaccgtcatattggcggcttccgctatgaacttcgcttgcttcatgaagtcatcgctttgcagaaactccccggcaagcgtgaagatgtcgccgcccttgcccaaaccgaagtcgtaccagagctgtttcgccacgttcacacggaaagaggatgtgcgctcgcccctgtacggggcaagataccacagctcgttaccgctccttctgacaggctcatgccccagccgtgcgagaaaatccgcaagcggcatccttctgacagcatctatttccgtcctttccatgcccgtgtcagttgatgatgaacttgataccgaccccgaactgcgtgtggaacttccgtgtgtcgccaccccaaaggcaacgctcccgcaggttggcaagcagggcgatacggtctgccacgtaacactccacatcgagcgtcagcgcaccgccgtagatgaaggcgtcccggtcgtgcagcgtggagccgtcatgcagcaccttcttcccccaatttaccgcctcatatccggcgagagccgaagccccggcatagacgaaaacaatctttcgggcgtccgacagtatcttgaagtaatagccgccctccgccgtgaactgcgccacgggtatcttggtgtccttgtagggattgttcttcaacaggtattcgccaccgaacacccacttgttccccttcttcgtgtaggtggagagagccgccccgaagctgtacccgccgtccttgccgccgagattgaagccgtccgccatgtccgccctcacctcgatgccctgcatcttcggcagacaccgctgggcgtgcgcctgccctgtaaaaagggcaagcgacgcgatgattattgcgatgtactttctcatggtcagcgtacttgaagttcgttgatggtacccgcgcgtaccaaatcctcgttctcaatcacgaaggactggtgacggccgccgttcttctcgttcaattccaccacgaggcacttgtcatcggggatggtgaacttcgccatcgtgaagaccgtgcgctcgctctttttgcccggcacgagggtggcgtagttctgcgcgcggagcggcagaataatctgctcctgcacggcagtacgcttcgcaaccttcttgtccacgattttccaagtgatgtagtccacatcgaaaggcacgttgctctggttctttatctccgtgtggaaataaagcaagccgttgtgcgtgtagatgcctttcaacaggtattggatgccgaaacgcttgcagccgatatgcttcacctcgcgcttgttctgtttgtggatggacttcatgataaggcgcaccagcatcgggctttcgctgcccagctctttcagatagatttcctgcgcgttgttcgggcggttcaccgtgctgccgtcatggatgaagtcgcacatctccacgttgagcaacagcggttcggcggcgtacttcacgttgaaggtgtagaaactgccgtcctccgtgatgacggacatattcgtttcgttgggaaaattccttacggtagccttcacacggatgatgttctccgctccgtcggctttcccggcaatcaggtcgggcgagcctaaatcgacatagcgcacctccgccggaaaaatgacgtggacggtcttgtcgtaggtcacttccagaccgtgcggcggtatcatgcggtcgaaggtcagcttgcgtgacagcccgtgatataggtcgccgtccgcctccttctgcggatagacctccttcgtcaaggtcggttgttcacttccgttggtcgtttcaacggttacattctcctgcgcgttggcagttatgatgcccatagcgagggcaaacatgatgattacttttctcattacttttggattttagtggtaatttttattgttttcaatatttttcttggtaaagcatgaccctgtacccggctttcagatgcaccttgacggttcgcatctttttggcgatgtactggctcgtgccttgtatcagccccttgcccaagtcggaggcgagctgcgccccggcattggtggagatgttgatgctgcttcccagcgagccgcccatgttggcggcgacctcccggacggcgttcatctccatcgagttcgggatgaagatgccgggctgtccgtccgtgtcatagaccgcaagctccacggggataatcgtgccgtcgtattccagcgaggtaatctcgatgtcgagccgctcaccctgtatcttgcccgtgccgaccaccaccgcaccccggggtattgtcctgcctgccaccgccataggctccagcaggcgcagccttaccgtctgcccgtccgtcacgctctgcgccccatgcacgcacgccggtatggtgttcctgtccaatacctccgccgtgccgacagccgtgttgaaaccccggttgcgttcctgcgataaggcggcgacaaactccgcgttactcataggctgtgagagtgaagaaactacttgatgctccacctgtctgataggcattgccttgttcttcttccctttctgcacggtagttggctctgccctctgttccgccgatggctgtcctccgttctgaccgcccatgtactttgccgccagctcgtaggacttctccataagagccacctgctcgtccatagaggaagccttgcccctctcgctttccagttccgactccagcgatgcgatgcgctccaacaattcgtccatctccgcattgtcgtttttcggctggtcgtagaagtttccgagcgtggcgttcaggtcacggtaggcggctgcggaggactggatggtctgcggcgtggctggctttgccctttcttccttgccgcccggattggcgaggtcgaagtccactccgttctccgttcccgctatctcgcggtcgaacatgtcgcccagctgcccgatggcacggttgcggctctcctgacgctcttccatctccccatgctcgtaggctttcagcttgtcgccgataatctgccggttcgccttgtcagcgtcgggcatctcggtgttgtatccgtccgttcccggcggttgctccttgccggaggacggggcgaatatcagccacatcgccccgatgaacaccaacaccatagcgggcagcacgatcatcttctgccgtttcagccgttgcgcctctgtcagcggttcgcgctcctttttcggtttccccgtttcgggagcagctttgttctctttcgtcggttcattctttgtctgttccatataaataaggtgttaagtgattgcctgtttccgccggggtcggcagttccacccgtccggcgtgtcccgtttccatatgtgagccgtcgttcctgccgatgtcatagacggctctgccgaaggtgtaaagggcaagcaccgcgaaggcggcgaacatccccagcacgatgcggcggcgtgtttccggcggcaagccgtccagataccctttgagacttgccgccaagcgtttccgtttgtcgtggagtttccaatacatgccccacattgattttctgatacttttcatgtcctgttaccgtttgatagtctgtaaatccttgttctcaatgatggtgaaaccctcgatggtaaaaccgttcgggttgtcatccgaccgcgatgcgttcagcaggcggcaggtggtcacgaggctgcgctcggtgacgttgctctgccggatgattttctgtgtggcgtaggtcacggcacggtagggataggcgttgaagtcgcacaccacgctgtccaccttcagcacttggttgatgttcccggcgatgatgcggttgtagtaccccttctccgcgaagtccgaataatagtggtacacgctcttgtccgccagcagcaaggcacgtttcacgttgtgttcaatcgcgcttttttcaggtgatagcgtgaagaacatctcgtggaaacggcgcacatgttcccgtgcctccgccgggcggttctgcgacaaatcctgagacaaggcgagcatcaggctcttgccgttgtccagcacatagattttctcccgttgcttctctgcgaaacggtaggagttccacacgctccacaccgtcaccacggcgcacagcgagaggaagacgataccgaacaggcgtatctgcctgaacgacgattcgatgtttctaagtgatttgaattccatttatattttccaatttatgattgcacattgattatttcagcaatttgccgacacgtccgactgcgtttcctgcggctgcacccgccacgctgcccgccatgcttccggctcgtcccgccatctggttcacgttgcgaccgtaaccgcccatgcctccggcttggataatccagcccgcaacggtgggaatggtaaagtagccgatgatgccgatgcagaggaatacgatatacaccccgtcgctcgaatccagcgagaagttcgggtctgcctgcatccgctcgatgtcgttttgcagcatcagaacctgtatcttcgccagtatggtgctgaacatgtccgataccggtagccacagatagacctgtatatagcggcatatccactgcgtgagcgtgttttggaaaccgtcccataccgacagggcgaaggctatcggaccgagaatcgccagcaccacgagaaagaaggtgcggacggtgtctatcacgagggcggcggcttggaacagcagttcgagtatctcgcggaagaagtcgcggatgctcttcttcatgttgtacattccccggtcgatatacattcccgccatcgtcaccatgtcggagggcgaccagccgagttcctccagttgcttgtcaaattcctcgttggacacgaggtaggcggtttcggggttgcgtaccatcgcctcgtattccagtttgtccttctgctcccggtatcggttcatgtccagcgtttccgcctccagcatctttgccgtgccctgtacgacgggtgagaggatgctgtttatcgtgcccagcaccacagtcgggaagaacatgatgcacagaccgatggcaaaaggacggagcatcgggaatacgtctatcggttcagctctcgccagcgactgccatacccggtaggcgacgtagaacagcgcacccagcccggcgatgcctttcgccacaccagccatgtccccacacagcggcatcatctgctcataaagtgaacgtaaaatctgatgaaggttgtcgaacttcataggctaccagtatctttcgttcatgttcccgtacagccccatgatgcggtcgaggtcgttcttctttttcgcacgcaggtaactcacggagatgttcttgttcgtgtagtagctcacgaggttgcggtaacgcttcatcttcgagtggcagcgttccaccacgtccatgcgctccttgtcggtcatggagagcgtggtgatgttcaccacgttcctgagttccgtcaacacttcgttgctttcctccagcagtttcgtgtagccgaaagcgattgcggaaagctcttcgggtctgaaattcccgtcacggagcatccgttggaaactgttcacatagatgtctgtgatgtcgcccaccatcaggatggtctgctgcaccttgcgggcgtccttgaccagattgttcaccgatttgagggcatcgtaatacttcttgccctgctgatagattttcaccgtctcctgaaagttgctcaccatgttcgtggcggtcttggaggtatggatgatgtttttggaggcattgatgatgccctgcgctagattgcccggatcgcttacgacccactgtgcgcttgccctgcccgcgaaaagcaggcacaggcagataatcattgttattcttgttctcatgttactttggattttagtggttgttattcttcggtcggatgtcccggctgcggcttcacccgcacatagtccccgtttggcgagaaagtcagcacatccgtggcctcgttgtaggacacgtcgatgcggaagccggtgttcatgaacaggttgccgttctcctcctgcaagagataggtttccggcttgagcttgcggcgcagaccgctacgacggaacaccgtcactttgtaggcttcgccctccttgtagataagcacgtcaggttttccctccacgctctcccagttcccgcacagcatgtcgcggcggttgtcggccacgtcgcaggattgcagcatcatgaccgccaatccgataaggcacttgctgacttgcagcattttcacttttggtaaattcatacgcgtttttcttttttggttgatacattctgttttttagttattccttgtttctccgcctttcggcaagctgccggatggcggcttcgatgtcgtcgcccagcttctccgccagacggtaaacctccactttttccgtttcctcggtggtgtacgccagatactcttccgcgctgacctccgtggcatagaccgccgactgcgtgccgcccaagcctatccacacctccttgtagagccgtgaagggttgttcgccatgttgatggagagtatctgcgacttctccttttccgtcagtccgagcaacgcctgtatctggtcgaacttgttcatatatttcctttggtcaagcaggattttacaatccgagttgttgataatgctctctttgaccaccggagaactgataatgtcgtccacctcctgcgtcaccacgattgcctcgccgtaatattttctgaccgtcttatacatatagcgcagatattcagccatgttcgccgatgagagggccttccaagcctcttccacgataagctgtttccgcacgcctttcagccgccgcatcttgttgatgaaggcttccatgatgatgatggtcacgacggggaacagttcgcggttttctttaatcgaatctatctcgaagacgatgaaccgcttgccgagcaggtcgatgttctccgtggagttgagcaggaaatcgtaacgcccgccccggtaatactgccgcatggtggtgagcatgttgtcgatgttgaagtcggacttctccaccttgatgtcacgctgtgccagttccttgcggtagtcgtcacgcatatactcgtagaaggtgttgaacgacggcacgatgctacggtcggattggatgcgctcaatataggcactcacggcactgcccagctcgccgctctccgtctttgtcaccttgtcgtcctccgacttccagagcgtcagcaacagggtcttgatgctgtccttcttctccacgtcgaagatgtaatcgtcggtgtagaacgggttgaagctgatgggcttatcttccgtgtaggtgaaatacacaccgtccgctccgcctgtcttgcgtcggatcatgccgcacaagccctgataggagtttcccgtgtccaccaataccacatgtgcgccttgctcataatattggcgcacgaggtggttcatgaagaaagacttgccgctgcccgaaggacccagcacgaacttgttgcggttggtcgtgatacctcgcttcatgggcaggtcggagatgtcaaggtgcagcggttttcccgtgagcctgtccaccatcttgatgccgaagggcgagagcgagctgcggtagttggtttcctctgtgaacaggcacaccgcctgttcgatgaaggtgtggaaactctcttccgccgggaagtccgccgcattgccgggtatcgccgcccagtagagtgtcgggcagtcgatggtgttgtggcgcggcacgcattccatgcttgccaactggctgcccacgtcgttcttgatatgcttcagttcctccgcatcgtcgctccacgccatgacgttgaagtgtgcccgtaccgaggtcagtccgtaggaatgggcttcgttcaggtattggtctatccactcgcggttgatgctgttgctccttgaatagcgagatagcgactgcatgttacgggcggacttctcgaacttctgcaaggtttcctcactgttgtctatcagcacatactggttgtagatatggttgcaggagagcagaagccccaccggggaggcgaatgacagtcggcagtcactccggtcggtggagagcttctcgtaacgggtgtcggtagccaccttgcccggcaggtcttccgcgtcggagagggtgtgcagacacaggcggttgtcgccgatgcgcatctcccttgccgaaagctcgatgtcctgcaaggtggtgtcaccttccggcatgagcgagaagtagcgttcaataagtcccgtctttccctcagtacccacaatctcatcggtggagaggcggcgcagcctgacaagcccgctgtcgttcatgatgcgctcgaactgttcgcaggcttccaagaacttggtcgtggtttccctgtccagctccttcgggatgatatgtccccggcacagcgtgctgaaattgctctgcatccggttacgctcctttgttgtcttggtcaggtagaggtagcaggtgtgtttcaggtacggacgctcgttgaagtgacgctcgaaagagcggcttaaaaagctcatgtcgtccttctgaagctccggtttgtagcgttccttgatgaaccagtcctgtttgtggacgacggagtagtccggcagcaccttgatagccttgcaccagcaactgtgtatcgcctcgtactccgcacccgtcacggtgtaaagttccggtagttccacctcgaaagccaccgtgatgtcggcgtcctttgagatgatgcagccatgctccaccgctaaaagtgggaacctgttttccagtgttgtcattttcgatgtattcctcattgtctttcttcctttcgttgtcgtttgaacagacgggttatccgccgccggttgataaggtatcggggatggctccgtgccgctcctaatttcatcagcccgtgttcaccgtaccgggcgttcagcgcgaaggtctgccatacaaggagggaggacgatgccgcgccgaagccgatacatatccactggtcgataccgaccatgtagaggatgacgaacaggacgaagagagccagcagacctccgcagaagatgaagaggtactgtgccttcaagcccttgaactctaccggacggccgatacccttgttgattgggtattcagccatacattatttattaaaggaagaatgagcgcaggatggtggcggcaacaatcaggaagatgcacgcgccgaaccacgaggcggctgtcttgctggtgtcggggtcgcccgatgaaaacttgccgtacacttttacgcccccgataagcccgacgactgcaccgatggcgtatatcagtttagttccggggtcgaaataagaactcaccatagaggtggcttcgttgatgcccgcgatgccgtttccctgcgcgaaagcggaggcggttgcggcgatgacaagtgccgcggagaggattgcttttctgtttttcaagatgttcttgttcataaactgttcttgttttttgccgtcaaaagggtggatggtcctttgtcgggcggttgatactttgtttctttactttggttttagtggatgcccgtttgtttccacggacgtgggcgtgtccgttgcggatggggatgcgccttgcgtttcctcgccgcgtgggttgatgtcattctttcatgttcatttcttttattgttgtcatacatagttgcgaatgtcgaactcctcgatgttgtccggcacgacgaactccttttcagatttcttcagccgaatctcgataagccccttgatgcggatgcctatctccgaagagccttccatcattttctcgtacaactccgtgccctccatgtcggtgaacaccttagccgccttttcacgttccgcctgtgtcgcgtccgggtttttggcggtcttgcaggcgtcgtcaatctcgtcaaagctgctgcccgaagcccgtggcgtgtccgaggcgtcctcttccggttcgtcgtccccgtatcccagttcctccggcggtatgctcgtgaaggtctcatcgagtttttcctccgggacttgtgccgggcgggatgcgtttcccgtttttccgtcgtcaaaagtagcctcttcctccgacagctcaatgcctttttcaatagtggcggcttcttgcgtcggtatggcagcggttgtccgggtggatgccatcctgaaacggctcttgccgatgatgtccgccttttccgcagggacttcctcgtgtgccgctatgcgtttagcctcattcccgtccagtgaccgccataatccgacaatgcccttgaagaagcggacaatccgcgtgtccatgatgcgctcgtaaaggagcaggaacaggaaccagaggttgcagccgaccgataccgccagcagaatgtctgtcatgctgattgtgtaattcatatccttccgtttttggttagaatactgaattgtaatttcgggcataaaggctctttatcgcatcttcgcactggttgaagtggtgcgtcagcacatggtcgatgtaagcggacagcgtaagccggtcatgcccgattacacgggtgatacgcatgatacgctcgtggtactccgggcgcacatacgccatcttcccctcacgtgcctttacttccgggtcgcggatgaacaggcgttcatagtccttctcactgcatttgccgcttaccgggacaggcgacagtatttccacactcgcctgcacttgggtaaacatacctccgcagtcttgctgtggtcttttttcattcggtgtcatttctttttccattttcaaatcagatcttcacgttgtttcttgtacagttcgttgattctctccttgtgctgttccagatgctggcgcagcacggtatccacatatccgcctactgagatttcccctccggcgatgtcgttcacgattctgaggatcttgccgtggacgtcacggctgatatagacacattggcgggtctttatctcgttgcggcgcaggaatagctcgttgtagtcctcgtcctgccttttccggcgtccactttccctctgcgctttttcccgtgttacgggttgcacaggagatggttccggtgcggcggtgtcctcttcggtcggtgcagctgcgggtacttcctgtgcggggcgcagtgtcccgtcctgtgtgcgccgcccgatggaggctaacagcagttcctcgtcgatgccttccgtgttcactttcctgctgcccatgctcactgcggtctgatgatgtcgcttatctcttcggaaaactcccggatgccactccctttcagcagtgccgtgtccatcgggaagatggtggagcggaaaacgctcttgcgctcttccgaaaggtcacggcggaacttcttgctgtcgggcaagcgggtggaaagtaccggaaagcccatttcggctatcacttcctcgtagatgccgtacaagtcgttcctctccctgccgtccaccatcgtccagaacagatgcagcccctttgttttcgcctgtccggtagtcatcagcctgtcgcggaacatcgtgacgaatttcagggtactctccacgacaaagcggtcggcactcagcggagtgaaaatgtagtccatctgcgagagcgtctttatcacgccgttgcttcggagtgtgccgggcatgtcgaagaacaccacgtcgggtttcacgtcctcagtggcaatcatcctctcggcatcgtcgagggcgttcaccgcattgcttttgacgatggtgtaggcgttctttttgatccggcggaaatggtcgcaagcgagagccttgaagtaggtgctgctgtcgataagccccatttcgtgttcgcgcagcccgtggatgctgtgctgcgggtcgtcgcagtccacgacggcgacattgtagcctttcacgttgtgcaggtagctggcggcaagtgccgtgacagtggatttgccgatgccacctttctgtgttgcgaatgcaacgaagatttccttactcatagttccatttattttaattgttgatgatttgtttttctgtttccatacggatttggctgtcgcaccatccgcttccgtgactacacacgcaggcgggtcgtcgcgtatccggttctgtggtgaagcggtgcgtcggacaaatggtgattgacgacattgcgtcatgaagtcattgaatccatacgtcaccgaattgtcggagaaccgggtttccgacggttcgggtatccgtttcggcaagtatccgaagaagcggatttccgggtatttgaatgttccgtttatcatatcttcaaatcgttcgtttcttgaatcatgctgcaaataaacaagtatattttggaacctgtatcacttctccggcaagtggcggcacgttgcgccggttggcagtcattgaccgggtcaagcatctgtccgataccgctttaagggcgtaactttgcacccggacagcagggttcgccgatgacgcgcggcccggagtcctgaaaggtattttcccaatccgtcccctgacggatttttatgttcacctgaacatagcaagatgtcttttcagccgctcaaaatattttgagcagccacgaaaagcacttgcccttgcagggggcgggctttccctccgaagtcgggaagcctttcagaactgcggtgctgtaatccgaagcggcggcttatgccgtcaatccgctaaatccaaagtaatatgaaagagaaaaggaaaagcaaatcagggagaaatcccaaacttgatccggcggtgtaccggtacaccgtccgtttcaacgaggaggaacacaaccgtttcctcgccatgttcggaaaatcgggtgtctatgcacggtctgttttcctcaaagcgcacttcttcgggcaaccgttcaaggtgctgaaggtggacaagacgttggtggactattacaccaaactgtcggattttcatgcacaattccgtgccgtgggtacgaattacaaccaagtcgtgaaggaactgaggctgcatttttcagagaaaaaggcgatggcgttgctctacaaattagagcaacacaccgtcgaactcgtgaaactgagccgccggattgtggaactttcaagggaaatggaggcaaaatggtcgcaaaaatcagtgtaggaagttcgttgtacggcgcgattgcctacaacggggagaagattaacgaggcgcaggggcggcttctcaccaccaaccgcatctacaatgacggttcgggaacggtggacataggcaaggcgatggagggttttctcaccttcctgccaccgcagatgaagatcgagaagccggtggtgcatatctctctcaacccgcacccggaggatgtgctgaccgatattgagttgcagaatatcgcccgcgagtatctggaaaaactcggtttcggaaaccagccttatcttgtattcaagcacgaggacatcgaccgccaccacctgcacatcgtgacggtcaacgtggacgagaacgggaaaaggctcaaccgggattttctctaccgccgcagcgaccgtatccgcagggaactggaacagaagtacggattgcatccggcagaacgtaaaaatcagagattggataatccgttgcgcaaggtggccgcatcggcaggtgatgtgaagaagcaggtaggcaacaccgtgaaggctctgaatgggcagtaccgtttccagacgatgggcgaataccgtgcgctcctttccttatataatatgacggtggaggaagcgaggggcaacgtgcgcggacgggagtatcacgggctggtctattccgtcacggacgacaagggtaacaaggtgggcaacccgttcaaatcctcgcttttcgggaagtccgcaggctatgaagccgtacagaagaagtttgtccgttccaaatcggaaatcaaggataggaaactggcagacatgacgaaacgcaccgtcctttccgtgctgcaaggcacttatgacaaggacaaatttgtatcccaactcaaagagaagggcatcgacaccgtactgcgctacacagaggaagggcgcatctatggggctaccttcatcgaccaccgcacgggatgcgtgctgaacggttcgcgcatgggtaaggagctttcggcgaatgccttgcaggaacacttcaccctgccatacgccggacaaccgccgataccgctatccatccctgtggatgctgcggacaaggcacacgggcagaccgcctacgacagtgaagatatatcgggcggtatgggcttgctcactcccgaaggtccggcggtagatgccgaggaagaggctttcatccgggcgatgaagcgcaaaaagaagaaaaaacgcaagggcttgggtatgtaatcagagtatcaacaattaaaaaatcaatgtatgtcacaacaagaagacgatttgagggcattggcgaaaatcatggattttctgcgtgccgtgagtatcattttagtggtcatgaacgtgtactggttctgctacgaagccatccggctgtggggcgtgaacatcggcgtggtggacaaaatccttctgaacttcgaccgcacggcggggctgttccattccattctctacacgaagctgttttccgtccttttgcttgccttgtcctgtctgggtacgaagggtgtcaagggtgagaaaatcacttgggggagaatctggacagcatttgccgtcgggttcgtgctgtttttcctgaactggtggttgctgcccctgccgctgccgcttgaagcggtgacgggactgtatgtccttaccattggaacgggctatgtctgcctgttgatgggtggtctgtggatgagccgcctgttgaaacacaatttgatggaggatgttttcaacaacgagaacgagagtttcatgcaggaaacgaggcttatcgaaagcgagtattcggtcaatctgccgacacgtttctattacaggaaacgctggaacaacggttggatcaatgtagttaatcccttccgtgcgtccatcgtgttgggtacgccgggcagcggcaagtcctatgccgtggtaaacaattttatcaagcaacagattgaaaagggctttagtcaatacatctacgatttcaagtatcccgacctatctactattgcctacaaccatttgctgaaccacccggacggctacaaggtaaagccgaagttctatgtgatcaacttcgacgacccgcgacgctctcatcggtgcaatcccattcacccggattttatggaagatattacggatgcctatgagagtgcctacacaataatgctcaacctcaataaaacgtgggtgcaaaagcagggcgacttcttcgtggagtcacctatcattctgtttgccagtattatctggtatctcaaaatctatcagaacgggaagttttgcacgtttccccatgctatcgagtttctgaaccgccgttacgaggatatatttccgatactgacctcttatccggagctggagaactacctttcgccgttcatggatgcgtggcttggaggggctgcggagcagctcatgggtcagatagcgtcggcaaaaatcccgctttcgaggatgatttcaccgcagctctactgggtgatgtcagacagcgagtttacgctggacatcaacaatcccgaagagccgaaaatcctctgcgtgggtaacaatcccgaccgtcagaatatctacggtgcggcactcggtctgtataattcccgtatcgtgaagctcatcaacaagaaggggatgctgaagtcatcggtcatcatcgacgagttgcccacaatatacttcaaagggttggacaatcttatagctaccgcccgaagcaacaaggttgccgtgtgtctgggctttcaggatttcagccagttagtgcgtgactacggggacaaagaggcgaaagtggtgatgaacactgtcggcaatattttctccggtcaggtggtgggggaaacagccaagacgctctccgagcggttcggtaaggtgttgcagaaacggcagtccatctccatcaaccggcaggatgtttccacctccatcaacacgcagatggacgcgctcattccaccgagtaagatttccgggcttacgcagggaatgtttgtcggttctgtatccgacaacttcaacgagcgtatcgagcagaagatttttcattgcgagattgtggtggatgccgaaaaggtgaaacgggaagaaagtgcctacaagaaaattcccgtcattacaaacttcacggacgaggacggcaacgaccgcatgaaggaaacggtgcaggcgaactaccggcgcatcaaggaagaggtgaagcagattgtgcaggaggaactggagcgtatcaaaaacgatccggtgctgtgtaaactgctaccagataatgagactgtctaacaagtccccaaaattgaaaattatccctatcgaagtttgaagtgacccccaaaagttggatacaatttttttggggggcacttcagttctgacgggtaaaatcgtaaaattcggacttgttagacaaatacttacgcggtttcaacctcaggtactgaatctatcgaattgacaaatttaaccaattgcggatctgaatctttttgtatgaggtttcggagactctttttcaattcataagcatcatcccctgctgtatttattaaatccatataaaaatctttgttttgcagaatcaatgaacggcatgccccatcggaaattacaggtttcactattttatcaataacgtctccagcttgacttttcaaattaccatgcgatctaagccatgtttcgaaaaattgaaactttattgcattgatagtctttttaccgatgcagaaatcatttcttatatcggtaactgtcgatttaatttttcgtttatccaatctttcaactatattcttgaaacaattagggaaaggattcaaactttgagttccagaagcaatatccatcagaatctttttgccaaattcagtcaagttatctggcaaggatttgattttagccagtaaatgttttattgcgacaaaccaataatatgatgtatgtgctgttctttgggcgtataatgtatcaacacttatttcagacaacgcttcgaacgctattttattgatatgatcggtcaggacattgcttattttagtggtcaaatcgtaaaaagatgcgtcaggaattacatctttaatattgttcttagtgatatacttatccaaatcggtattccactctgctaaatgctcgataaatacctcatccgttacacctattctgttcttaatatcttcaaattggggcaatatgtctgagagcaataatttatagccaagtttatgatttaccatgtattgtagtgtttcatttaatagcggtatattccatcccacactatttactaataagtctccatgatccacataatagtccatgagttctgcaacatattttatatctccaccctctattaaggaaacggaatgaccatgtgccaattgcatggcgactaaatcgtaatatccagactctttaatgtttcggccatcagtttctaattcagaatgcaactgatttatgtaggttgaatctaacgttacaggtaaaggtctttcttcgtcagatgccaataaacgataggttgtaaatatagcccctatattatctttatttacattctgttcatcaatgcaattcgtgatcgcttgcaaaagcgttggaaacgtataggtagaattatcttttaacgtttttacaatatctgcatggtcgaaattatcgggtagtaagtttgccaaataattatcgagcgcctccgaatttgttgctacttgataatatttatatgctttagttgtcgcgttatcccgataggcagcatctgttgcatttgcagcttgaatataatcgataaatgtatttggcttgactgtttttgcttcaatcaatgacgtaaaatcgcacgccaacttattttgcgcaataaacctgtctattgcatctaacgttttgaaatagtcgccgccattgaagtcattgaaccgaactatcttcttatataattgagcaatcacatggttttggctttccgtgtctaaatgcaacagcagttcttggtattcgacagggaacacctgcttctctatggattcttttaatttcaattgtgctattctttgccatacacgcagaataacatcgctctttcgagttaatttatgcaaacaatgtataatcttatcgataagcgcattgtccatacattgtataacttcttctaatacagtgtcaaattgtttattagtctctgcatattgatttatgtcgtggtcttcttctccgttgatgcagccttcaatatattttttcaatggaatttgtcgagcatcttcaacatcgacaccatataccaaagctgcaatttcgcgttgtgtttgcagatcattgttaattattgtttgaatgccattcagatagtcgccggacaatatttgttctactggatttgccagaatatccgtcttcttcaaacagaacaatgctatgtttatcatcaaaatttcgttacaccactcttgtttaagagcgaccatctcattgatatatgatataatttccctaacattggcattaggatttaccaatctgaatatccgatttatagtttctttcgcttcattttctgtttctccaaatgcttcaacaaacagtttgttgaatatacttcgatagtcggtaataacaggaggagcaacacgataaacaatagggaaagttttattgataaaatacttggtcagttgtttcgtttgttcgtcggtctcatctccgaatgcacaagctaaatgtgtttcatcgaaaggaataacagcccaaacattttcaaaaccgctatcggcgaagaacgtatggatagaagaccataattcttttactttttcagcggggagacgatccatgttgtcaaaaacaaggactaatttacgttgtcctttttccttgataaaatcagaaatgtcttgcatccatgttttgaactcgtaaaccgttggttcgtcttcgctcaaagtctcatagcaaacgtccttttcgactttatcttgataaatagctaacatataactccatccatatttatgatctttgctatatgcccatttccaaacgcacaatgcaataagaactggcagtgcagctatgataatagacaataaagaaaaccaccatgttgtgggtgtaggttttactgcatacgcaataaatgtaaatatcggagttaaaactgcaaccaaaaatgccgcaaccataccattactgataaggggatatttttcggttacggtctccgttttacgggctaataaatatttcagcttttcagaccatgatacggttttcgtacctccacctttgacttttattgttgcatttccagataggataccatcatcaataagtttgcttgtaagcaattccaatatagagcggcgttgcaagtcctcttgatgtccccatgcgtcatactcaaaaaagtaatagtcgtctgataattcacgttccaacattttaaccacgttggattttccagatccccaaataccttcgatgccgataattcgaggtaaagtacattcctcatccaatgaatcattctgacaaaaatggcgagcaatagtttttgccaacctttcttgcgaacctccatcgaatttgtcaataccacacggtttattttggataaaccgcggatattgctgtttggattgtagttttgtttccatatacgtaatttattgattatacgaactccaaataattctcccgatttaccacatgaaactcggcatagggataggcttcttggaaggctttcggtgcggccggcattttatttccccacttgaactccaaggcggtaagactgtcggcactctcctcaatcaggtcgatttcctgtttgtcgtaggtgcgccagaaatagaactccctgtgcagtccctcattgaagttcgctttgcgccgctctccgatgatgtagttctcccacagcgcaccgacatcctgccgaatggccagcggtgagaaagccccgataatggcattgcgaatgccgttgtcgtagaagtaccacttgccagcttttgtaacctccttgcgtaggttacgcgaataagcccccagacgatagataacgaagaccttttccaataggtcgaggtatttttcaacggtcgtcttgctcatgccgagttgtttacctaactcttcgtaagaaacttcgctgcccaactgaaaagctatcaatcgcagtagatcgcgcatcttgctcgaattttttaagccgtcaattgctaagatatctttaagcaggtatgcaccgacaatatcacgtaggtagtctgttttacgttcatagttctccatcattactacttcgggataggaaccgtaaatcaagcgcgcttcgaggttctggcgggtttcaagtgccgtttccgtctgtgcgatttcccgttgcgagaatggtgtaaggagaaattgcgtactgcggccgaccaacggttcaccagtcttattcagcaaatcgaatgacgaagaaccacttgccaagacacttattcccggtatttcatcaactatcaacttcagaatactaccgatttgtggtatgttctgtgcctcatcaatagccagcaaatcaataccatccaataaatgccgataattggctattgagcgattctccaatagtgctaatgtgtcgtagtcttcgccgttgagcatcatcgtcctacctgaatagttgtccacaattttacgcatcattaccgttttaccaacacggcgagcaccaaaaatcagtactgctttattgggcgcgattcgtgctgtaatcttctcttgaagtattctatttactgtttccataccttataaaatataatgcaaagataatcatatttttttaattggcgaattttacaaaaaaaacgggctattaaatggcgatttttacaaccacaatcttatggaagttgtttcattgtttttagtaatgatatatgttcatactatgatgactcaataatttaccagacatacgtttctgaaatttgtccttataggaatgaaaaactcacatatattgtgctaattaatatataattaaatgaaaataaaaagacaggatacgagtattcctgtcttctcatatgtaatggatatttttttattttctcatccgctccaactcctcatcacgcaacattctctcgttcagtttttcctgcatcctgtcaatgaaataggtgcggctttcgttcttccggcgtttgatatcagtgtagaagcggtagcagtctttagaatcaaccccgaatatcttatagagaagtggggcgagctgtttgagcggcatattgccgttgttgatgcagcccatcacgtctatgccgtagataagttccacgaggtcgatggcattgcccgtccattgaagaaggctggcggtggtttctgttgcgttgttggcggatattagtggtggcacttggggcgtggcaaggaatttctgcatctttcttacgaaagacagagccttgctgacgtaggcggcaatctctcttttttcttctgacagattacgtacgggatggtgctgcaactcgatttcgatgtaggcaagcgcgatgacggtaaggttcatgtccatgccgccgttgcacagttcgatcacttgggtggcgaaagccgtgtatgccgtttccatattgcagtcgccggcttcgtttatcaggcggaaaaagtcggtttccgccagcaagaaataattcatggttctgtcaattttgaaaattacactttgttttctgcgtgcgcacatgaatataattggcaaaaaacgcggcagaaaataaaaaatccaacactcaattttacaaagtgctggatttcagaggtataaaattcagtattttttcacaaggacaaattatctccgacttaaattgtttgtaatcggaacatttattctattcctgaaaatagaaatgtatgcttgccgcacattttggctatcttgcttttttatcaaggatatagataatgcgacatacaccgttgggatagcttttcaaagaggaaagcgtccagtgttgctctggcagagccgacttaaaaaaatgtcgtccgcttccggatatgaaaggaacggtgtatagtatgatttcatccacagcgtgcatccgcagcagtccgtttatatagtctgccgtgtccggtgtggcttccgcgaggtaacggatgtttgtgcagtcttttctccattcgtgcagcattgaaatggaatagtccggtgtcacacggtaaaaggctttcttcctgatttcatcaagaccgcaacggtcaaggcacaaatcctgatgtgctttatcatataactctgaagaaagacatccgtccatcgtcagtacggcgagaatctgaactttacccataatcgtttcctttcgttaggcaagggtaaaaaagtagcgtgcaattcacactaccttcaagcgatggctctggtaaagcctttacggagagtacgtgaatgcacgctatgcgtaagcatagcataagcatcacgcaatcgtctccgtagttccaatttaccagattttcgcttgaaacgccttgcggtcttatcctatatgttggcggcgaaaagctcctgccaatcgccgtttttctcaaatgttatgcaaagatagccaaattcagtgaattacgggctatgattgcttgaatttatatttaagtccatactcttcaagtttgctgtatagtgttgtcctgcctatgccgagcagttctgcggcgacactccggttgccgtttgcctgtttcaacgcacgcaatatccgctccttatcctccgcgtcattgcgcaaggcgaagctgacagtagaggtcggtttcgtcacggcaagttccagatgctctttcatgacaacaccttcctgcgcctgcaatacagcacccataactttctgccgaagttcccgcacgttgcccggccatgcgtgtgtcagcaacgctttacgtgcttcggaactgaacccgctcacgctacactccagctctctgtttgccatatcacggaagaactctgccagcggcataatgtcttcttgacagtcacgcaacggaggaacggttatcccgaagtcgtgcaggcggtacagaagatcctgccgaaaacgcttttcattcaccgatacctccaaatcttcattggtagcagcgatgatgcggacattgaaattccggtctgccttgtctccgaccgggcgataccgcctctcctgtatggcacggagcaacatctgttgggtttccaacgcgaggtttcctacctcgtccagaaacaacgtgccgccttccgcctcatggaaatatcctttcttggcattgtccgcacctgtaaatgcacctttgacgtgtccgaagaaagccgacggtgcaagctctttggagagtgaaccgcagtccaccgccacaaatggcttgcctgcacgtttgctcttgtcatgcaacaggtgggcaatatgctccttgcccgtgccgttctcaccaaatatcatcacgctcatatcggtggcggctaccagccttatgcggtgcatgattttctgaaaggcggaaccttcacgggcgaatataggcatacggcgttgtcctgcctgacgttctttcagtatggaacggatcagggggacaagtttatcctccacaagctgtttgggaatatagtctatcgagccgagtttcatgctttccacggcggtattaacttcggcgtagtcggtcataatgatgaagggctgcatctttccctcctttcgcatccagcacaaaaggtctatgccactgccgtcaggcagacgcaggtcggcaaccacgatatcattatctgttgcctgttgcagatgtttcttcgcggttgagaggtggtaagccttcatattgcggtagccctcccgtgacagcatattgcagacatattcgcaatacacgatgttgtcttccaccacaattatttttgtcttattcatcttcgtattttctcctttcctcttctgccaaccgtattatttccactcccttatccagcacggcagtcacggcatggcttaacgcttcaccatccgggagagcatcgccacgaagcaatccgtaaagtacattcagcggttggtcggcacggagcacctcccacgaactgcgcaggtggtggatcagggaatccagcttttgcaggtctttttcttttgctgcatcccgtaccgcctgcatttccttttctgtttcagttatcaacttttccagcatgacggcttcattgccataggacaataaggcggaaaagtccggtttcccgtccggtgtcgcttttatggcacacctgtcggaaacctccatcagttccgatatggagaacggtttgaacaggcatccggcaaagccttttgccaatagttcccctttgttacaactgcccgaagcggttgccacaaccaccgggattgttggtgaattgcccacgttggacgaacgcaacagttccagcaattcgaaaccgtttatatcgggcatattcaagtctgtcagcaacaggctgtattctttctggcgtatcatttccatcagtgccgcagcatcggtgcaagtgtcgcagtgtattccttcttgggaatacatctctttcagcatcagaagtaatacctcatcattgtcaatggcgacaacatcatggaatttattgttatgataaacaggtgtattgcttgtatatccaagctgttcttcagcttcctgcatagaaatttcaactgtgaaacgactgcctttccctttcttgctgtctaaacggattgttccgccaagcatcgacacaatattacgcattatggcaagcccaagcccgaaaccctcctttgcggcggcatttgatagacgttcaaacgcaccgaacgcttgtttctgttcctcttctgtcatgcctgtacctgtatcttcaacgaccagtgtcagaactccattatcatattcagtaatcaaagaaacaccgccttcttctgtgaacttgacagcgtttgacagcaggttattcccgatttgtattattcgctctttgtcggtcaatacaatggcatcgtgtccagtcttcacggacaaggacagccctttgttcacggcaacaggcatgaactccgtttcaagtgtgtgcgtgattgctgaaatccggcagggtgacagacggggctgttccttgccgttgtccaggcggaagaagtcaagcaaagtgttaagcatatcccgcatacggtcggaggattgcagtatgttttggatatactgcccggacttatcctcacactgttctttccgtatcagtccggcatagcctgttattgctgtcagcggtgtgcgcagttcatgggtgatagtatgtaccgccttcttccttgacgttatcagtgcctcgttccgttgtacggattgttccagttgccttatcaaatcagttgtcttgtgcttgtattgtttaatgctttttgcatcacgatgtatgatgatgtaggaaattaacaacaatagaagaacgaatcccattaaaccgcctacttgcataaatgacttttcacgcatggcaactatttcgttttcccggctttgcagttcggtttgtaccttttcttctatttggcaaatcaattcttgcagttgtctgttaagttctgcattacgagctgcaaggctgtcggcttgttccgacaattggcgatcctgcactttctgttcgctgattacgtttctattgaccgaatgaaggatagtggttgatactgctggagttacttccttttttttgccgaatatgcctaagaaaccttttcgttttggctttttggactgttcctgcacacttttctgtacaataaccggaatttgattggctatcttcttgttaatagattgttgttcatccattaaccggactatctggaacatctgtcgttccttatcctctaaaagactgcgcacactatcgatgcgctctgctggataggtggccttgaaacggcagagcatactgtccattgccatacgccgtgcatggtaatgctcgatatctttatcgttccattccagtattgtttcacccaatagagaaaattttatcatttgaatattgatattgtttatttcttttcggagctcgtctatttttttattgccaagttctaatgcttctatctcctgccattcatagaggctattatatgccatacatccgataagaatggagataagtatatatcccaaccgtattgccttatagaaatttcctgaccgctccattattttaatgacattgatttttggaacatgaataaaagtttatctttttcgttcatgcggatattatcagaataaccgtcttttgttatttgatacccacatggcttaaccataaaaatgcctaagcccttagtgtacgaacttacttctgaggcatagtctttacttgtatttaatggaactttccctttaatatgacaccactcattattacaactgatgtcttcaatctcagacatcagtttttgcaaatctgtaatagctttggaactcgctacttggggtatctgcaactcaaaacagagcatcggttcgagaatgtccacacctgactgttgcaaagccagcctgaagacataaggggtcagctgtctgaaatcagcaggtgtacttaccgggctataatactcggcttgagtaaaagttactttcagatctgtcacttcccatccatgtaaaccagattggcaagacatacgaatcccttcaaaaacggcattttgaaaagaatggttcagataaccataggagatgtcactttcgatttgcaaccctgcccctaacggtaagggttcaagagtcagccctattgtggcccagtaagggttgggtggtacttcgatctgaataatcttattgaccttttttataggtcgttctttgtagatagtcttgatctcatcaaaatggacctttacggaaaatcgttcttccagcaatgtctgtatgatttccttttgggtcaaaccatataacgagatttccaattcatcactatatgagtttatggaaaaggacaaagacgggtcttcaatccacaatgtattcagagcggatatcaccttgcttctctcttcgggcttatttggccggacggaggatttgagagcgggatgctgatgagataatccttgaatcaaacaaggtttagcacctaaataatctccgattcgaaaatcttctatatcttctacaatcgcgatatcattggcacccacttcatcaacatttatctctctgccctgataaatagtctttagatttttaatcttgatgaatttttccgaatcgttgattcttacaacgtctcgaagtctcagacttccgtcaattattttaagaaaacttcttttatgccctttggggtcatgctctatcttatagagataagctgaaagtctgtttgagactgatgccggaggaagtataaaagaagaaatggcgtccaacaactcattgataccgatattgaacattgctgatccatgtagcaccggatagactttggcttttgccacaagagcgattatcgtattccaataatcagccggtgaaatttcgctatccgccaaatatcgttctaatatatcgtcgtcatggttgcatacaaattctttgtattcttcctttatatatgtttgggagcaaaccggataaaccgatccatcgacaacagtttgcataaacaggacatcttgcgacagatttgtttttatatccatatacaaacgctccaaattcacaccggcacggtcaatcttattgataaatataattgtcgggatttgcagcttttgtaaagtactgaacagcaactttgtctgcgcttgtatgccttcctttgcggataagatgaggactgctccatcaagcattttgaatgtccgctccacttccgcaataaaatccatgtgtcccggagtgtcaatgatattgcatttcactccattccagataatagatgtcgtagaagcccggacagtaattcctctacgtttctctatatccatagagtccgttatggtgtcaccattatccacacggccgcacttttccgttgctccactggcaaacagcagattctcggttacggaagtttttcctgcatcaatgtgagcaagaattcctaaatttataatattcatttggattaagcaataatatactacagtagatgcattgtcgaaacgcaccttttaatacctcctcgtagcatatgagaactacaggattactaactcgtattaatatgtatattattactgccgcataacgattacaaaattacacaaaaaaatatatctaacaaaagtgggaggattttttaactttttaccatagacattttattagggaagcgtaggttcaactggcaagtacaaataagtagaaatgtttgaacaacaccgttttaggaagttgaaaaatcaagtttctctctcggtatagcgtttattttggccaatatcttctttagtttagcatttgtgtatttcccattcgtgttctatttagctccttattatgagtatgtagcaagttacttatcaaattcagcctctttgagggtcaaatatggttttgcaaatggtgactgacaagacataaacaaggtcagcaggaattttttacataaatggacatgaatgtatataacctaaaataagaataaattttaataagggctgcccaaaaagaaaaaaatgcagttgccatcctatagatacttgcagaaaggataaaatttacttttagaccttttgggatagcccttattaatacttcagataaaattccttaggttatattttcaatcctttggaccgggtttcctccttggcatacagtcccggacgcccgattatgacatggttggcaacgatactatccgccggactgcgtatctgcggcggtgcattttcgggatattgcgcctgcctgttcctcacatcttccgcttccggcttgagctgttgcccttcattctccttttctgcgacttcgggcgtgggtggcgcaagctccagctgaatttttcggtcaagggcggcaagttcggacttcaactgcttcagctcgtcctccttcttccacaccttacccgctatctcctgtaactgcggtatctccatctccagcacctcgttcttcgccttgtactggtcgatgatggagggtatcctctccatcgcgttgaggaagttgcgggcggcggccaacgggtcagccatcgccagatgcccgttgttgtaggtgtacttgtagttcccctcgaccacgaagcggttgtcggtgaactccaatccctctttgagtatcctttcgctcaccacctttatcggaaaaccgtaaagttcaccgacctgcgtgtacaaccctccggtcgtggcattcttggctatctcctgcaaacgctttccgatgaccttctcatcggcggaatccactccgtccacctttattatattaaggcggttgccctccttgtcggtctgcaccaccgacaggaagcggttccagtcctccgtcatggcatctatgaaagccgtgttgttgcgcaactcgccggtctttgactccagcttgaactccgaatcacgcttgcccttgttgaacgacttgcgttccccttcgagcgatgcgatccgcttttccagtttcgccttgtccaacaggtcggtattgccggagagcaacgccatgtattccgagaaattcatgcccgatttttcgtccattgccccctcgtcgatggtacgcgcacccatcgcaccgcttttgagctggcttatgaaagtctgcttgcagtgcaggaggttgaacttgtagctgtccagtgacttctccaccgcgtagatgattacatccacgttgttcccggcgaaatgtttggcaatctcattacctgccctaactccgcgtccgtcacgctgttgcaagtcggacggtcgccacggcgtatcgagatgatggatagccacacaccgtttctgggcgttcacacccgttccgagcatagaggtagagccgaacagcacacgcaccgtcccggcgttcatggcgtctatcaccgccttccgcgccttgtcggtcttgcactcctgaatgaagcgcacctcgcttggcggtataccgtagtcctccgtcagtttgcgcttgatttccgaatagacgttccacccgtcgcccggctggtatgtccccaaatcagagaaaacgaactgcgtgcctttctgggcgtcgtatttttgataatactccgcgatcatcttggcacagtgactcgctttgttgtcgggatgatcttcgtaattcgggtctatcatgcgcatgtcgagtgccattttccgggcatagtccgtggcgatgagcatcttcgccttttcttccgtttccgaaagcggcagcctgcccaacaaggtggcatcgcccgtcttggcgaactgcatcagtttctgtatgaagtcctcctgttccggcgtgggcggtatatggtgcagtatctcgttcttggcaggacggtcaacgcccacatcctccgccgtgcggtagtccgtgatttcattatagaaggcggcaagctccggcactttgatgaagtagcggaaacgctccttctggaccacattgttcgtcacgttaaattcaaaatccgtcgtcttcttggcaaatatcgccgcccaagcgtcgaaacaccttatgtcctgccgttccagctccttcgggcgcaggtacttgaacagcaggtacaattcagtcagtgagttgctgatagtcgtgccggagaggaaggtcgcacccaagtcttttcctgtgcgctcctgtatggtgcgtatggcaaagagcatgttaagtgccttctggcttccctcgctgtttcccaatcccgccacacggtcgtggcgcgtgttgaaagtcagattcttgaactggtggctctcatctatgaagatgtggtcgatgcccatctgcttgaaatccaccacgtcgtccgtgcgtgactttatggcgtgttccaccttctccagcttcgcttcaaggttgtgcttgcgcttctccaatcctttcagcatcgcccgcgacacgttctttccctgctgccgtagcacttcgaggttttcctccaccgtgtcaagctctgcttgcaggatgcgctgctgcaattccggcgactgcggtatcttgccgaactggtcgtgcgacatgatgacgcaatcgtagtcgttgttctttatattattgaagaagcgcacacggttggcggtcgaaaagtccttctccgaagcgtacagaatacgtgcgttgggatatgccgcctgataggtggctgcaatctccgcaacgttggctttcagcccgataatcatcggcttgtgtgccaaattcagacgcttcatctcatgcgcggcgatgcacattatcagcgtcttaccggttcccacctcgtggtcgcaaattccgccgccgttctgtttcaacatccagacgcaatccatctgtgagggatagacgctcttgataccccggcttgccagccctttcaggttgaggtcgggaaaggtctgatgggagccgtcgtagcgcgggcgcacgaaacagttgaacttgcggttatacatcgtcacaagccgctccttgaactgcggcgactgctcttcgagccattcggagaagccgtttcgtatctcgtcaatcttggcgttggcgagttgtattccctcgctgtcgcgcatcttgatgtcgttgccatgctcgtccttgccgatggacttcatcatgtcagggcaggtgttgtgcagggcgtgttttaggaggtgcataccgtcatagttccggtaataccccttcaccagaaactcgtccgtgattttcatggtgcggtagccgcacaccaccgaaaactcgtccatgcttgcggaataggcgattttcacctccgtgtcgaacagccggctcatgtaggcggcatagacacccgtcggaatccagcgttccccgaaattgaagtccagatcctcgaaggcgatgcgctgcggctcggcatctttcagagcctccaacgcctgcttcacctccggcatacgctcattttcgggattgtcacccatccatgcctctatgcgttccgctttctctatgacatttccggcgatgaaacggtctttgatttcgtaaccggtcacgagcggattgtagtagatgcgcccttgcagggcagtgagcaaatcctccgccgtgctgtcggttatctcccgcatatagtcgagattgaccgtaccatatttgttgagcgacgcagacagggcttcttcgggagagcctacgttggcatggctctccaccgcgaaggaaacaggatgctcgaagatgtccgccttgacgaactttccgttttccatccgttccagcgaaaggatgtcgcgcccgcccgcatccatcatcactaacttcacgttctgcttggcgttgaggttgccgtagcgcatgacaaactcatcgtaacaggtattcagatgctctcgccacggaacatttgcctcgcgccggagcgattcataacggtacagacgctcgtaggcgtcacgcagcgacacatacaacaacgccttttccttctggtatcctttcaggtcgagcggctggaatgtcgccccgtatggcgtgatgtctttcaggtagccgatgttatgacgcccccggtcagccaccagcgacccttcgcgcaggtgcatctccggcgtgcggtggtaggcacgcggagaaaggtccacgacttcctccttcggcttttccgcttcgatgtcggggaaaaggaaagtccccaccgcttccgatggggtatctgtaacggcaggtgcggcgactgcctccggctgtgtttcctcctgtcgtggctgctcacgggaagtttccggcacggctttcacttccgtcttttccgccacttgtttctcgttatgctgccttgccagttcccgaagttctttcctacgctccggcgtcaaacccatcatcatttcatagaaaccgttgatgggaggattggtatcccagtccagtgtggcatagatgtcgtccgggtcggcaggcttggcggtgttctccgctttcacctccttattctccattgcgggttttgcagttggagctgtcggtgtaaccgtgactttcggtttgggcggagtggactttgccgtaactgcctttttcaccgtctttttctttttggaggttttcggttggctgacctcttccgtcatcccccagaggtcaagcagggtgagctgcacgcctgcggaatattgcgggcgcggttctatctccggcttttcatctgcgggttgcggcttttctgtcggagtttccaccgtctgcgccgaggatactgtttccaattttatggcaggacgctctactttattttgaacggcaactttttcttccgttcctgcctgccggattgaacccgaatacaagcgcatggcaagcctgtaatggaaatcctcgtcgagcatacggcgcaaatccccggcgatgcctgctgccttgccctcgtgcagataaaccatagcgggcttcccgtaggggtctgtgtcaagtttcgccatcgtatgcacgatgcgttccgggtggtggatgaaataggcgttgtcggtcagggcggttttcgtgtccgtctgtatcacggtcatcagccgctcgtcctgcgacatttccttcttgctgaggttcttttgcaggacaatcaggtcactgcccacctccgtgcccgcgttgtccgtgaacaggttgttgggcaggcgtatcgcggataccagattggcctgactgaacagctcgttacgcacggaggtcttggtgctattcaataccccttgcgaggtgatgaacgccacgataccgccgtcacgcacggcatccagtcctttgagaaagaaatagttgtggatggttttctgggcggagcgtctgccgaaagagtcgctccgctgaaactccgcgtcgaacacggcaatgtcaccgaacggaatgttggacaccgccaagtcgaaataattgttgaacggtctttcgattttctcaaaaccgcaggtgcgcattttctggtcgggatagagatgcctcaagattgtacccgtgagcagatccttctcgaaagccatcacatccgcattggggctgtgccgcagcatggaatccacgaacacgccgacacctgccgacggttcgagcatacgggcggggcggacgctgtaatctgccagcacgtccgcgatggtgtcggttatctctttgggggtgtagaaagcggtcagcacggacgctttcagcgaatccacaaaccgcttgtactctgtttcgtccttgctgttctcacggataagcctgtgcagctccaccgtcggggcgaacagttcgaggtcggatttcgcccaccggacggcatccgtcagttcctttgcagggttgaggatacatttcagaccgccgaaaccgcagtacctttgaagtatggcacgctcttcggttgtcgctgtcctattttccctgtcaaggatgaatgccgtccgtatcgcctcgatgttgtcccgcagtttctgtttgcggttaaacgccatattcgtctaagtaaaggacggttgctcccgtcagctccgtgtagagcaggtcgtaatcggaagacagggcgaaattgtcatccgagaggtcatagacggagaacacgttgccgacaagcggcagcagtttcaggacaaaggcttcacgcttctcttccggcacttcatcggcaaactcgttttccacgacttcgcggaggatggcgtaacgggaataatgcagcccgcgcagcagcgtgtccatcgccagttcctgcgcaccatcggcgggatagccttcaagccgtgccctctcatacgtttcggcggcacggtcggcccgttcccgtatgaaagcggtgtcgtcagcctgttcaaacttgttcgtgcggagatagtccagcaggtacagaccgtaataggaaaagtcggtctgaccctcgtttttcttcttgttgttcattactttggatttagcggattgataattaacgggataatcggttggaaaaaggaagaaaaaggcactcggtatccctccgagtgccaccactaaatccaaagtatgagtgtaatccggtatcgaagaacaattcattactctgaacaagtggcaaagttaatactatttcttccgtcctgaaaatttcttgtcctttttagcctccgggaacacaaaagtcgtgttatattccccgtcaaaggcgacaacagcatcgaaactcttgccctgtttgctcttgaaccctttgagcagcttggtatgcccttcggtgagcaggtctttgatttcatcgtcggacagggtgcgtcccgctttcagccggaacacgggcagtccgcactccgtgttgtcgcagcgtaccaccttgccgtagaaccgcatcctgcccgtgccacacttgggacacgcgcagccggagtcacggctgccgaagagcttgtcgcacgagatcagttcggaggttatctcacgtgtgtacgcctctatctccttgcggaaggtgtcgtcggacagttccccgcgctcgatacgcgccagctccttttcccattcgcccgtcatggcaacatcggcgatgcgcatcgtcttgacgacggaattgagggcaagtcctttttcggtgggaacaagcgacttcttgcagcgttccatgtaaccgcgcttgaaaagcgtttcgatgatggaggcgcgtgtggcgggagtaccgatgccacagtccttcatcgcctgccgcagtgcgtcgtcctcaatttccttgcccgccgtttccattgccgagagcagggtggcttcggtatgcagcggcttgggtttggtctttccttcggtaatggacgagcctttcggtgtcagcgtgtcgccttcctgccagccggggatggtaatttcctctttttcctcgccatagacggcacgccatccggtttgcttcacgacgctgccttttacggtaaactccactccggcacattccgccgtgacagtggtcacatccttgacgcatttctcagagaatgcctcgaccatgcgcccggcaatcatctgatagatggtattgtcctctttggagaggaagagcggtttctcacccgtgacgagcagggcatggtggtctgtcaccttgccgtcgtccacgctgcggcgtgtcggggcggcttttgcccgcaccttgtctttccattcgggctgtgtgccgatgaaagcgagcagtttgggaatttcggcaaacacgtcttcggggatgtagcggcttcccgttctcggataggttatcaacttcttttcgtagagtttctgcgcgatttcaagcgtctgttccgccgtgaagccgtgcttggcgttggcttctttctggagcgtggtcaggtcgtagagcaagggagtttcctccgtcttctccttgcgctcggctttcgtgacagtggcgcaacctgccgcctttaccttattatatagttccatcgccggttctttctctttccatttctcggaggatgagaatttcacgacttcgccgtcgcaaccgtccgttgcgatatggagctgccagaatgcttcggacgtaaagcggcggttctcccagtagcgttcacataccatagccaacgttggtgtctgcacccgccccacggaatacgtgccgtgtccggcggcgatggataacgcctgtgtgccgttgatgcccacgagccagtcggattcgctccgcgctttggcggcgaggtagaggttgtcgtatttgctgccgtcttcgagtttccgcagtccctcgcggatagctttgtcggtgagagagctgatccacaggcgcacgaaaggagtggtgcaacccgtatagtggtagaggtagcggaagataagctctccctcgcgtccggcatcggtcgccacgatgatatgttcgcttgtgtcgaacagtcttttgatgacttttatctgcgacaccacgccgctgtcgggcttgtaacctttctccgtcctgacctgacgggggacgagcgtgaatgtgtcgggaataatcgggaggttgtcacggacaaatccgcgcacgccgtagccgtcgggcatggcaagctgaacgaggtgtccgaatgcccatgtcacggcataaccgcctccctcgaaatatccttcctctctctttgtcgcgcccacgatgcgggcgatttcacgtgccacggagggcttttctgcaatgattgtcttcatgtcttcttcttttttgttgatactttggattttattttggattcagtggcggacacgggattacattttcatgcccttgcccgttttcttctgcggcttctcctgctgctgttgctggcgggcgtccttcgggttggtctgacctttctgcaacggctctctcagattctttgtagcctcgttggtcttgccatcgttgttcaccgccacctgcgtgcggctctcgttggacggagcaacctgctgtgcattgtcagggttcgtgtcgtagcggtacgggcgtcccttctccgggttgaacttgatatacatcgtggcatggaagccctgcttgtcggtcacgttctccagcttcacggctttacccgccacatagtcggctttctgctggtcggtgaagctcacgccgctccatttgctgatggggcggatgctgccgtcctcgttcgtccacgtgttgcggcgttgctccttcttggtctgtgcggcattttccccgccctgcgcctgacttttcgatgtgtcgcctttggtttcctgtgtctgtgcggtacggggcgacttgccggttcccggcacgaactccacgccgcgctgctccacgttcacttgcagggtggtgacgaactttctgccgtcgttgcgctcgatgagcttgtcgcgtacgggcagtccggcgcggagcatgtcccgctcctgcgtggtgatttccgtcttgccgatgcgctccgggatgcgcaccctgcttgccggaatgtccgtgatttcattcgtcttgcggtcgatgctgatgtaggaggggatgatctcgcccgtttccctgtccacaatgtccacgaccctaccgagattgcccgtttcgcggaggttcttccggtcattgtcggagaatttgtgttccttgtactcatccagcttctgctccttgcggatgaagtgcggcacgaggctgatgtttccctcaccgtccttcttgaaggagaggcgggcgtccagctcgaatgattcgccgccgaaggtcggtttgacctttaccaagtcggacttgccatagttgagcatcttcgtaaggtcgccggacttttcaaggttgtcccgctttacgccccatctgtcctccagctcctgccagttgattttactctcgtcgatgggctggtagccacgtttgccctgcatctgttcggatttgtcctgttgctgttctttccgttgttccatgttctcctgtttttgaggttcttgtttctctgtctgttgtgctgccatctcttcctgcaccttcttctcatagtcggaggtgtccaccttgtgaggggcgagcagctccttgttcgcttcggggtctttcagcagttgcttcatcacctctaagagattttcagcttggtctgccgcaatgcggtagaaaccgaagcggctgggttccttgcactgccggaagaagttcttgaagaagttgtccagcacgtcgccatgtcggtcgaattgcaggaaactctgcgcgttctccgcttttgcgggggtgcgcttgggtgtgccgtccgcgttcagcccggctaccacgctgatctcgcctgtcttctcgtcacggactaccagcacgtccttttcgtcttttttctttgccatctgaaaaatgttttaatgggttatttatgaaagaaattatggatacgagccttgtagaaggctatatcttcctttttgaagtccttgatatggttggaaaggaatgtcagcacgtcctcctcgctgtaataggtcttcttgcccagcgtcttgtagggcaatgcgcctacgctgcggtagcgttggagggtgcgtttgcttatctggagcaacatgcacaaatcctgattgtcgaaaaggcggatgctttccgtgatagtgggctgtttcccctcagccttcatcgccagcagcagttcgtcctgacggtcgagccgttccatcagcttctgcatccagccctcgaagttgtttcgtgtgagcagttccatgacctatgtcctccttccttttggtttgccgcccgtgcgcagcgtgtggttgtggaacagggtgtctattgtcccttcctcgttccttactgtgttgtcctccaatagccgcagtatctcggaaaggcggtagcggcagcttccgcgtaccaccacatactcgatacggtggtcggtgcgcatacgctgcatggtgcgcttgctcacgttgagcatcttcgccgcctgtgccgtgtcaagcagcttgtcttcggtttcccgcttccgtttcttctcgtcccttgcctcgcggatgtaccctgcgatgttcgcaatctgcgccatcatctccttgtaggcggaactttccattgttatcactttcatgttcagtcctttctttttgtttctgcgacaaaattcggcaataaacaaaaggggctttaacaactcactacgtgactcacgtaagatttttgcggaagatggctccgtaacccggtcaaacggcgcaacaggcagcctttcagcggaaaacgatacgtcttgtatgccgtttcgttacctttgcggcaaactctaaatgacatgaatatggaaatagtatctatcgagaaaaagactttcgagatgatggtggcggcattcggcgcactctcggagaaggtcgccgccctgaggcgcaaaagcgacacggggcgcatggaaagatggctcacgggcgaggaggtctgcgggcagttgagaataagcccgcgcacgttgcagacgctgcgtgacaggcggcttatcggctactcgcagataaaccgcaggttctattacaagccagaggaggtgaagcggctgataccgcttgtcggcacgctctatccgcacggcagatgatttgatttattcacccactgaatccgaagttatgatgaacgagaacaacgatgtttttacgatggaagacgagccgatagcctctgtggtgcaggatatgcgcaaaggctcgaaatggctgtccgcatttctggaaagctaccgtcctccgctggacggggaacgttacctgacggacggcgaggtgtcggaactgctccgtgtgagccggcgcaccttgcaggaataccgcaacaaccgcgtgttgcccttcatacttttgggagggaaggtgctttacccggaaacggggctgcgcggggtactggaagcgaactaccgcaagccgctggagtgaggcggtttcatgaaaaagtaaacgggtgacaccttttgtggtgctacccgtttacttgtcttatggggtatgtgcaatcagcaatacccggcttttccgttctgtatgaacatcacgtatgtctgccgtttctcttgtgagagtgcctttcccaccagccatgtgcggaacaggtgggtgttgtaggtattcaccctgaaagcgaccgggatgatgatttcaagggcgtacacgtccgcgtgcagcccgttttcaagctgcatgtagcggcacacctcgtagtcgttcagcacgtccgacttgcggacggctctgatggcggcgttcactgccgggacggtcgtatggaacaatccggctatttcggtggcggtcatccacacgtcgttaccggttacgctgactgccttgtcctcgatgatgattgtgtcacgtttcatggcttttctttttagatggtgcaacctgcaaattcctcgacgccgttcaatcttgcggcaaggttctccatgtcctgattgagcttctctttggttatctttgcgtaaatctgcgtcgtctttatgctcttgtgtccgagcatggagctgaccgtttcgatgggaacaccgttggagaggaatatcgtcgtggctgccgtgtggcggctctgatgccacgtgatatgcttggtgatgccgcaacgcttggcgacggcacggataccggcaaggcacgtgttataatgcggaacgggaaatatcctgccgtccccgcacagtccccggtatttgccgattatgcggttggcgatgtcgagcaggcggatgttggacaccacgcccgttttctggcggttgatgtttatccactcgtgttcgtcgaagtaggtgcggatattctcttccgtaaggttgcgcatatccgcgaacgacagccccgtgaaggcgcagaacaggtagaggtcgcggtacaattcctgtttggcgtttttcagtttcccctccatcagcaggcggatctcatctttggtcaggaaactgcgtgttgtttcctccttcttgatttcatactcgcggaacgggtcgcgcgtcagccactcgttgttgatggcgatgaataccatcgtccgtaacgggcagacgtacagccacacggtattggtgcagcagtgcttgtccgtgcgcaggaacatctcgaagtcggagatgaaagccggggtaagctcttttagggcgatgtccttcacatggtagcggatgtcgaggaactcttgcatgtgcttgtaaacggtgcggtacttcagcagcgtgcctttggctttcatgcctgcctccacctgcttctcgtagtcctcgttgtgctggcggaacacctgcatcagcgtgtggtagcggtgttccagtccgagaaaggcgttcttcaccttctccgccgtgacgaagttgtcacgctccatgatttcctgataatgcctgttgatgcgtacccgcatcttgtcaagcatacggttcgtttcgagtgccgccgtgcttctgcccgtgacacgtccacctttggtgtcccacagtttcggatcgacagtcagtttgcagctgaactgtgtctggctgccgtccaccgtgatgcgtcccatgacgggaactgtcccgtcctttttcactacctgacgcttgaggtagtagattactgaaaatgtactcttcattgtccttaatttttgggtttcaaaattagttggtgaagagtccggtgttggtacgcaaaacggggaggaacggcgcaatctttttccgtaacctgatttttcgcatgagttatggataactcactattccttagagccttgtttcgctattcgtacccgtttgtcgcattttcgggcatggttacgaacaagtaacgtagcggcgtcaggatttggcttcggcagggattgtaatggcttcacggattatcgccacttcaaccaaaacccttgtaactcaattctatcactatatctttccgcatttcacttttttgtagtaactttgcgagtgaataaatacaataaggtccaaaccgataaaacaaatatgagaagaattgcaatttatctattgtgcatattcatgttactgcctgttgtaacaatgacagcacaacctggttataactactcaaagttacaacgggagaaactaaaccgcggcgtagttgccattcgcgaaaacccttcagaagtaatcgtttcgtggaggtatctttcttccgatccgatacaaaccggtttcaacgtatacagagacgggaagaaattgacagacactcccatcactgtcagcaccctgttccgtgataagaataacagtcagaaaacggctgtttacgaagtgcgtcctgttctaaaaggaaaggagacgcatcacattgacggtacatacacattcccggaaaacgcgcctctcggctatctggaaattcccctgcaaaaaccggcagacggaataactccggcaggcgatacctacacgtacagtcccaatgatgcttccatcggtgacgtagacggtgacggcgaatacgaaattatcctcaaatgggatcccagcaattcacacgacaatgcacacgaaggttatacaggcgaagtatacatcgattgttaccgaatgaacggagaacaactatggcgtatcaacttgggtaaaaacatacgtgcaggagctcattatactcaattcatggtgtacgatctggatggtgacggcaaagcggaagtagtgatgcggactgccgacggaacagtggacggaaaaggaaaagtaattggaaatgctgatgcagactatcgcgaagccggtacttttgacccaagcaggaatcaaatgatgaagcaaggacgtattctgaaaggcaaagaatacctgactgttttttcaggagacaccggtgaagccttacataccatcgactatatccctgcccgcggcaacgttgccgactggggagacgcaaaaggtaaccgaagcgaccgcttcctggcttgtgtagcctatcttgacggagtacacccaagtgttgtcatgtgccgaggctactacacacgcaccgttctggcggccttcgactggaacggaaaagaactgaagaaccgatgggtattcgacagcaaccatcccggatgcgagcagtacgccggacaaggaaaccacaatctgcgtgtaggcgatgtggatggtgacggatgcgacgaaattatttacggttcctgtgctatcgaccacaacggcaaaggactttattctacccgaatgggacatggagacgccatccacctgacacattttgacccttcccgtaaaggtctgcaagtatgggactgccacgaaaacaaacgtgacggaagtacgtacagagatgccgccaccggagaagtgttattacagataaaaagcaataccgatgtaggacgttgtatggccgccgacattgacccgactcatccgggtgtggaaatgtggtcaggagattcacaaggaattcgaaacgtaaaaggagaaatcatagcccctaaaatgagaaatatgccgaccaatatggctgtctggtgggatggagacctattacgcgaactattggatagaaacatgattattaaatacgactgggaaaacaaaaagtttgttccgcttgtcaaattcacaggaactcttttcaacaatggaacgaaatcgaatccttgtctccaaggtgacattataggcgattggcgggaagaagtactcgtacgctccgagaacaacgctgctctccggctctacgtttcgactattccgaccgaatacagattccacaccttccttgaagaaccgatatacagaatcagtatcgctacccaaaatgtaggctataaccagccaacacaaccgggattctatttcggaccggaccttataaaaatgaaaggtactttcagaggatatcaattcaagtaagttaagagactatcatgaaacacaaattatttcttttcacatttctcctggctatactgtccgccattaatatacaggcatccgaacgcaaaaaatacaatttcaacagcgaatggaagctgcggataggagactttcctaaagccaaagatacaaaattcgacgacagtaaatggaaacaagtaactttgccccatgccttcaatgaagatgaagcattcaaactttccattgaacaattgacagatacagtggtatggtatcgcaagagtttccagattccggaactgaaaagtaatcagaaagtattcgtcgaatttgaaggagtacgccaacgcggagacttctatcttaacggacattatctaggcagacacgaaaacggtgttatggcggtagggttcgacctgactccacatatcaaagagggtgagaacgtgattgccgttcgcaccgacaacgactggatgtacagagaagaaggaactaactctaagttccagtggaacgaccgcaatttcaatgccaactatggcggtattcctaaaaacgtcttcttgtacgttactgataatgtatatcagactcttcccctatatagcaacctgaaaacgacaggcgtatacgtctatgcccaagacttcgacatccaaggacgcaaagctacgattcatgccgaatcggaagtcagaaatgacagtaaagctacccggcaattcagctatcaggtgactatacttgatgccgacggcaaactaatgaaaactttccaaggtgataaagtgactttgaaagccggagagactaagacggtaaaagcatctgccatccttcataatcttcacttctggagttggggatatggttacttgtatacggtaaaaaccgctttgaaagatgataataatcagatattcgacgaagtcagtacccgcaccggcttccgcaagacccgcttcgcggaaggaaagatatggttgaacgaccgtgttatccaaatgaaagggtatgcacagcgcaccagcaacgaatggccggcagtaggtctgtccgtacctgcctggttgagcgatttttctaatgacctgatggtgaaaggaaacgcgaatctggttcgctggatgcacgctactccgtggaaacaggatgtagaatcctgcgaccgtgtaggtctgatacaggcaatgcctgccggagatgcagaaaaagaccgtgaaggacgtcaatgggaacaacgggtggagttgatgcgagacgcgattatctacaaccgtaataatccgagtatcctgttctacgaatgtggcaacaaagccatcagccgcgaacacatgatagaaatgaaagctgtccgcgacaaatacgacccgttcggcggacgtgccatcggatcacgtgaaatgttggatatccgcgaagcggaatacggtggcgaaatgctgtacatcaacagaagcgaacatcatccgatgtgggcgaccgaatattgccgcgacgaaggtttaagaaagtactgggatgaatatagctatcctttccacaaagaaggtgacggaccactttataaaggacaaccggccactgactataaccgcaaccaagatgaacttgccatcaccatgatagcccgctggtatgattattggcgtgagcgtcccggaacgggtaacagagtcagctccggcggtactaaaattatcttctccgacaccaatacccactaccggggtgcggaaaactaccgaagaagtggagtgacggacgcgatgcgtatcgaaaaagatgctttctacgcacatcaggtaatgtgggacggatgggtagatacggaaaaagaccagacctacatcatcggacactggaactatccggataatacggtaaaacctgtgcaggtagtatctaccggagaagaggtggagcttttcctgaatggtaactccctgggtaaaggcaaacgccaatacaattttctctttactttcgacaacgtagccttcaaaccgggcaaactggaagctgtcagctacaataaagcagggaaagaaatcagtcgttatgctgtaaatacagccggtgaacctgccagtctgaaacttaccgctatccaaaaccccgaaggctttcatgcagacggtgcggatatgacattgatacaggtggaagtggtagataaagacggacaacgttgtccgttggacaaccgcactattcagttcacactcaagggtcaggcggaatggcgcggaggtattgctcaaggtaaaaacaatcatattcttgatacaaaccttccggtagaatgtggtatcaaccgcgcactgatccgcagcacgacggctgccggaaaagtaactctgacagcacaggctaaaggacttctaagtgcctctctcacattggaaacggtgcctgtaaaagtgaccggaggtttgagtacctatcttccgcaggccactttgaaaggcagactggatagaggagaaacaccttctaccccttcttacaaagacagcaaaaagggtgtacgaatcgtttcggcaaaagccggttccaacaataatgatgctgaaaaaagctacgatgatatcgaactgaccgaatggaagaatgacggtaaactaagcactgcatggattacctatacattggaaagagatgccgaaatagacgatatatgcatcaaactgcaaggatggcgttcacgaagttacccgctggaagtatatgccggcaacaccttgatttggagcggaaacacggataaaagcctgggatatattcatctcaatgtagaaaagcccgtacgtgctaatacgataaccatccgcttgaaaggaaacaccagtgacaaagatgctttcggacagattatcgaagtagaggctatagcggccaatacaatggaattggaaaaaagcagtagcaaacaccagttgagaatcatcgaagttgagtttctcgaaacaatcaaataaaaaagttccggcaatgttgtttatttgcctgccatcaagtatctttgttcataaactgaattttaacgcttatgtgtaaacaaccggatatcctagaaagtgaaaagattcactttgcagtcatggcaatagaagctggagcacgcgaaatgggaatttctcctatggaaatgcgccgacgtttagagaaaatgaatctaatcaaacgtcttctactggacaattacgaagtgatgcacacacaaagtctaaaacatgtaggcgaggatgtggtcgaggctttgaagaactgggaggcacaggagggcgagaagggatgaaaataacactttatcatggctccaccctttctatagagcatcccttagccaaagtgggacgtgccgatttagatttcggtagaggtttttatctaacctcactacgctcacaagcagaacagtgggctgcccgcgtacaactattacgggcaagtactactgcatggattaatgtatacgaatttgatatggatgcagctataaaagctggattcaagctacttcgttttgatgcttacgatcagcattggttgaattttattgtcgctagtaggaatggaaaacagccttggaaagattatgatattatagaaggaggcgtagcaaacgatcgggttattgacaccatagaagattaccttaacgacattatcaccatagagcaagccctcgggcaattggtatatgcacaacctaatcatcagatatgtttgctcaatcagcaactcattgatacatatctacattttgataatagttttccactggatactatggacagaaaaggaggtaacaaatgagagaacaagtactttggagaaaaatcagtcgcatcgtcctattattatcagcccgattggagataagcccggaaagagcattaaatctgttttatgaaacgaatgtatgtgccatgttacatgactcccgttacggactgcatctaatgagtgatacttatattataaatgatgtattgcgtgaattacaagacaagcagtaattttagaatatattatgataccaagcaaacaaaatctcttcttttcataccgttcctttttgaatccttatcactcatttttttcatttattccttcattattcacaccacgctgataaaccgatggtgccaccccaaactgtgctttaaagcatttgctgaaataaaaaggatcactgatgcctaccttgtaagagacttccgcaaccgttagattatcttctgacagcaacaactccgccgctttcttcattcgcaccacacgcaaatattcattaggcgaatatcctgttacgccgcgtaatttccgataaaaaacggttcgtcccaacttcataagctgcgcaaactcatcaatagaaaattccgggcgggcaagattctgttcgagaatggcagccaagcggtctgcaaattctttatcccgttcggtagtacacatagccggtcgcacaatacccggttcgttggagaacttctcacgcaatttatcacgctgttcgatcaaacggaatacacgtgccaacagcagtttaacgctgaatggtttggcgatgtatgcatccgcacctgcctcaattccttccagatgcttttccggtgagttcaacgcagtcagaaggataatgggaatatgactcgtatcaaaatctgtttttagtttcttggtcacttcaaatccggtcattcccggcatcagaacatcacagataatcaggtcggcatcatacgtacgggccttttcaaatccggacgtgccgtcggcagccacttccacttcaaagtatgcgccaatttcttcccgtagaaactcacggatatcattatcatcttcaataatcagcactttccgtttgttcaaaggagcagccatcttttccgggtcaggaagctcttccgaaagctgtaacaaatgatgtacgtgaccgtctgcctctttcagcaatacgttgcccggaacaaggaagtctttctccgaatacaccgtcttatctgtcggaatacatacggtaaatacagaaccgccaccttcattgtctttatactcaatcgtacctttatgcacctgcaccagttcgtggctcaaatgcagaccgactccaatactgtcaccggagaaattactctgcataaaccgcttgaacaattcattctgtttctctttaggaatccccactcccgtatccgaaacctgaatctgcaatgtttgcttcccttcgtccacattcaccgaaagaataatcgttccgttggaaggagtatatttaaatgcatttgaaagcaggttataagtcaccttatccaaattacctttatcaataaacatcttataagatggcaccgaaggcaagaaacggaagttcatattcttctgttccgccacgtcgccgaaactcaaaaatatttcataaaggaaagagatgacatctgtttcctctaaagaaagcgccagtttattattctgcatctttctgaattccaataactggttgatgagtctcaacatacgttgcgtactcttatccattgttttcagaggatatatcaattcgcgcggaatatccgtgacacgctggattttctccaaagctccctggattaaggtaagcggagtacggaattcatgagatatattggtgaagaagaccagcttatattcagtcagttgcttctcgacattgatacggttgcgtaaaccattgaagttgcgaacaatacggaaggcaaaatacaaggctaccatcaataacagaacatagcacaacattgcccaggtagtcttccaaaacggcgggacgattacaatcttcagtgtagtttcactgtcgttccatatacccgatccattgctggacttgacatgaagtatgtaggttcccggattcaggtacttaaaggaagcgaagttcagtggagaaggagcactccatccctggtcatagttttccagccaatacatatatttcgtatgtccgctatccgaatagtcgaaagtagagaaatctatcaggaatgagttttgaaaatatttcagtgtaatttcatctgaataagcaagagactgttttaaaggagaatcctccatctgcggattcatctgggtcccattgacgtacaaatcagtgaaaacaaccggagaaaacgtttcactatcttgtatcttttcagggtcgatcacaattaatccatagtttgtaccaaaaagcaatttcccgtcttcacgcatacaggcactattctcactatacacattacctaaagtataggaagaaaagaaatagttctcaaaagaacgggtggacggggtgaacttggaaattccatattcagtcgctacccaaaggtttccttttctatctcccaaaacagactggatcacatcattgaccaacccttcggaagttccgtaatgctcatatttcaatgaatgatagtcgtcctgcggcgtacagaggttcaatcccgaaccggaagtaccaatccacatacgtcctttcgtatcacgatagatacatttgatttcattactgcagaattttccgtttgtataactgaagagatgataattatcgccatctgcaatcagtgagtccggatgaaagatacaaatcccctcactggttcctacccagaccattccgttttcatcttcttctatcacacgcaccatcctcattccgaacgtttgctggaagaaatgccggaatttatatttcccgtcagaagtaggttcagccaattcgagccctccgccgaatgtacccacccacatacggtctttgcgatcgcgataaatagcaaaaacgttattatccgacaatgaagtcgggtcggacggggtattataataccaggtatctcccaccttcaatccattaccacgggttccagtccacatccgtccctggcgatcttcagcgattgcataaatattggaatgaaaatattgattcgtcattttcgactgaagatttgcgtcaaaggtataaagtccgcctttacgcgtacctacccaaatatcgccattagacattttggtcaacatacggatggtattcgaacggtcgaacagttcacgggattcgggatagatgcgggaagttccttcattcaacactgaaatgcgggataaacccgaatattccgaagctacccagatgccaccggcacgatcttccatgacatattgcaggaaatccgaactgatatgactttgatcgttaatgttggctacgaaatgttccagtttatcttcggctgtgttataagcaaaaagcccattcccataggtagaaatccagatgattccgcgggaatcatgtacgatatgataacgttcgaagtcgatgtaactgatcttatcttgagggatcaactggaaatctttactttcaccggttgcggcaaccacataggtgaggtgtcctgtatgattatatatccaatagtctccgtggttgtcgcgaatcagttcgccctttttaatattcagacgggggtcagcggctacttctccggtcgtaaaatcataagtatatactccggtcgtagtcagaatcatccatttatctttcaacaagaaatttccggtaggtgacgtctgccctgcaacggttgaaagggcagccagcttctgcatcttctgcgtagccgaatggtaataataaatatctccatctgccgtaaggaaatacatgtcatccttataagccagagaagaagtgaaatgaatcaaccggtcttctatccgatattgtccgttggagacagaaaccaatccgcattgagtgcctatccagatacgtccactggcatcttcattcacgaatttcacccggttatccggcaggtttccacgttctgtcctgaatacggtagatgtcatttcaccgtttttctgatgcaccatacgtcggcaaccattgccttgatgtgataaccatacgtctccgttggctgtaacaaatacagtagagtaattctgccttaactcaccgcaacccgtgtaatcaacaaaacgggcacgttgcaaatcatagcagctatatagttcaggtgtagtggaaatccataaaaaaccatctttatcttctgtgagatcgtaaatccggttgtcggccaaagacactttatctccggcttccggacgaaaggtcaggaaagagttaccatcataacgacttaatccgttcaaggtagccagccacaaaaaacctttgctatcctgatagatgtatcggatagagttgttgggaagaccgtcactagttctcatttgtgtagaacgaagctctattgcactataagcattcagtacaaagctaacaaggaaagtgaaaactaaaaggtgtctttgcgtcataaagattccaagattaataataaatgttggacaaaaataatcaagatagttgagataataaaagaaacactccattaaatagtaggaagcggatatgctaaagagcaattactaccattatttagacgcggattacacgaatgacgcggatttttcattcttaaatctgtgtcattcgtgtaatccgcgtctaaaaaattacagactgatagaattactgaaaactcaatccatgtggaacacttccggcaaaggaatggataccggtgagttatccggattcacttccatgatatccgccatataatcccaccatttctgtacgatttccgtattgcctaaatcctgcgaacctgctcccccttccgttttttggaaagcaaacaggatatttgtttctttatcccagtaaatcgaatagtccgacactccattctgtgaaagcagtgctttcagttcgggccagatggcagcatgtcttttttcatattcggcttcacatccgggtttcaaatacattttaaatgcttctcgtttcatggtttcaatctatttaaagttaatctttcttttcttctgtgtcgatagcaaaaataggtgctgtcgtcttttgtttcacctggtagtattgaacggcactgtcattcatctgtggatattgatttttcaacaagcgaatcatttccgcacctgcccaaagaaccggtccgtaaccatgtgccgcatatacattgaccggacggtaatagtaaaaagcagggtcgaaagccattcccgtaccgacacaggttccttccacttgcccctccgcatttatcttgccggctacggcatgccatcccagatgagcaaccggtccgtaagcaatggcgtcaatccatcctttattgatggcgtgtgccaggcagtatacatatatcgcagtagcggaagtttccaggtaagaatcattccggtcgagcagttggtgccaaagtccttctccgctttgcaaggctgtcactccacgtacatgagcccggaaataatccatcactttcgcacgttgaggatagtcttccggtagaacgtcgagcagttcgcaagccgtcagcatagcccaaccgttggcgcgcgcccaacaaaaagcaggatgatcgctactgctttccacccatccgtgacgatacagtcctttttcggggataaacatgcggtcggcaaattgcaggaattgtctcactgcttctgccagatatttatctttttgatccttgtcataataactcatttgtgctactgccggaatacccataaacatatcatccagccaaagagtgttatgctgcggacggttgcgtgcaaaagttccatctgccagacgatactctttattaatgatgaaatcaaaataattacatatcagttcatccacaggaagcgagggatctttcaaacggactttcaccatcgccgcgcatacggctcctgcgtcatccagtgcgtgcggagtgaggatttgaagcaactgcgggtccgttgtccccttttctttataaacacgcttgaaatgcggtgctacttcggccagaaaacgaaaacgattctgtacataatccatatagcgtatgtcgcccgtagcttcggatgccgctatcaaggcagagtaggtcactccccattcataacttgccaaacgaaaagctccacgctccagttgtgcctcctctcccatcgttgtatagtcggtaatcactttacccgtattcttgtctaccacacgggcgggagtctccttatctatataagcaaatacacggtctacctctttctttacctgttccggtgtcaaatcaccatacgtgccctgataagcaggttgcaataaatgcaaaggggtgtttgagtcattcactacagttttctttttctgtgcgctgacaggcaaagctatcagcaacaaagtaatggctatgatacgaatattcatattttattttttaggtattttacatcctctgaatagggttccctgcaaatccggcccaaagtagaatcccggttgtgtcggctggttgtaggctacgttctgggtagcgatactgatgcgataaacaggatcctccaaaaaggtgtggaagcggtaatcagtgggaatggtagagacataaagtcgcaaagcggtattatcggctgtgcgcaacagtacttcttcccgccagtcgcctacaatatctccttgcaggcaaggtgttgccttcgttccgttgttggaaagagctccttcgaaaatggctatacgctcacagactcctttcttccaattatatttgctgactatatttctatccagcagttcgcgcagtaaatcaccgtcccaccagacagccatattacatgacaatcctctgacacgggctttcaccacttctccttttatatttcttattcctccggaagcaagagaccacatttcaacgcccggatgggtcgggtcaatatcagccgccatgcaacgcccgacatctgtactatcttttatctggaaaagtatttctccggttgccgcatctctgtacgtacttccgtcacgcttgttttcgtgacagtcccatacttgcaaccctttgcgggaaggatcgaaatgagtcagatgaatcgcgtctccatgtcccatcttcgttgtgtacagccctttgccgttatggtcgatggcacacgagccgtagataatctcatcgcatccgtcaccgtctacgtcacctacccgaaggttatgattaccttgtccggcatagtcttcacaaccgggatggttactgtcgaaaatccagcgttctttcagttcctttccattccagtcgtatgctgccaatactgtacgggtataatacccacgacacatcacaacactaggatggatgccgtcgagataggctacgcaagccaaaaagcggtcactacgattaccacgattgtctccccagtccatcaggtttcctcttcccggtacgtaatcaattgtttgcatcgcttctcctgtcagtccgttgaagacagtcagatattccggtccggtcaaaatacgtccctgttcattccgatagtcagcttgcgcatctccaatcacttttccttttccgtccactgttccgtcggcggttttcattactacttccgctttaccgtcaccatcgaagtcaaacaccataaactgggtgtagtgtgcaccggcacgtatattacgtcccagattaatgcgccataaatgttgcccgtttaatttataacaatcgaaatatacctctccggtgtaaccgtcatgcgaattatcatgtgcgttcgacggatcccatttcaagataatctcatattccccgtcaccgtccacatcgccgatactggcatcattaggagcatagaaataactttgccctgccggagtcgtaccgttttcaggacgattcagcggaatgttcagataaccagccggagcatcggacggcaattgataattgctttccgtttttgattggatagctttgacggtataaagtacggattccgtacctttatatatatcctgaaagaaagtcgcatttcttatcggatatttgtttaccttttcaccgtttctataaacatcaaaagattcgtccatcgggtcggaggacagataacgccaagacacggcaacagtagatggattctctctgatggcaattaccccgcgtcccaaatgttcgcgtttcagtttcgaaaagtcatagttcggctgcgccactacaaaagcagctatcagacacagacttaaaaaagcacttatgcatttcatagttttatcgttaatcaatttacaacacaaaagtaagcggcacagcctacttataaaatagaatattgtacagatctatgtagaaatcatcatatagcccacttttaaaccgcattataactacctggtgaacaaaaatgaatatatctgaacggaaatccattgaaaaagaaaagtgcgtcccttatctttgccaatgaaaattagaatgaacacccaattaataaaacagaattatttcaccatgaagaaatcactactctcattctttacagtaactcttctttgtcttatgacaggaaagccggtcatggcacaagagttacctgcacaaaaagagactttagagactatcgtaaaagtaaacgactactttatgaaaaagtatgccgattacacattgccttctttctatggcagagttcgtccaagcaatatatggacgagaggcgtatattatgaaggattaatggctctgtatggcatttaccctcgtgaggattattataagtatgcctacgattgggctgatttccacaaatggggaatgagaaacggcaataccacccgtaacgcagacgaccattgctgcggacaagtttatatcgacctttataatatgtgtccgtccgatccgaatatgatccggaatataaaagcaagtatcgatatggtagtcaacactccgcaggtgaacgattggtggtggattgacgctatccagatggcaatgccaatctacgcaaagtttggaaaaatgaccggtgaacagaaatactacgataagatgtgggatatgtattcttacactcgtaacgtgcacggagaagccggaatgtataatcctaaagattgcttatggtggcgcgatcaggactttgatcctccttacaaagaaccgaatggagaagattgctactggagtcgtggaaatggctgggtatatgcagctcttgtacgggtattggatgaaatccctgccaatgaaacacatcgccaggactatataaatgattttctcgctatgagcaaggcacttaaaaaatgtcagcgtgaagatggtttctggaatgtgagtcttcatgatccgacgaacttcggaggtaaagagacttccggaacagcactgtttgtatacggcatggcttggggagtgcgcaacggactgctcgaccgcaaagaatatcttcccgtccttttaaaagcatggaacgctatggtgaaagatgccgtacatccgaacggattcctgggatatgtgcagggaacaggcaaagagcctaaagacggacagccggttacttataagagtgtgcccgactttgaagactacggagtcggttgtttcctgcttgccggaacagaagtttataaattaaaataacatagacagttttttcattaggtttaaagataatcattcattaggtttagttagaggttagttagtagctagttccctcactgactgtttagacaccggtcagtgagggatttcaaagaaaacagattcatgaaaaacaaattattcccgtatatatgttggctgatggccattacatttagtttgcaactgcaagcgcaaaataaagtttccgctcccatggcagacgtcaatcaagtaattgacaacacgctggacagcctgaataaagcacgtacctcgcgaccggaagccggttcgagccggaaaggtgacaaccctgttctgttcctggtaggtaactctaccatgcgtaccggaactttaggaaacggcaacaacggacaatggggatggggctattatgcaggtgattatttcgactctaaccggattactgtagaaaatcatgcactgggtggaaccagtagccgtactttctataaccgtttatggccggatgtaatcaaaggagtacgcccgggagactgggttatcatcgaactagggcacaatgacaacggcccatacgacagcggacgtgcccgtgcttccattcccggaattggcaaagatacactgaacgtaacgattaaagaaaccggagtaaaagaaaccgtatatacctacggggaatatatgcgtcgtttcattcaagatgtaaaagccaaaggtgctcatccgatccttttttcgcttactccccgcaatgcttgggaagacaaagacagcaccatcatcacacgtgtcaacaagacttttggattgtgggcaaagcaagtagccgaagaacagcatgttccttttattgatttgaatgatatcagtgcccgcaaatttgaaaagttcggcaagaataaggtgaaatatatgttctacatcgaccgtatacatacaagtgctttcggtgctaaagtaaatgctgaatctgctgctgacggaatacgtgcgtatgaaggactggaattagccaattatctgaaacctgttgagaaagatacagtgacagattccagtcggaaagagggacgtccggtattgtttactatcggagatagtacggtcagaaatgaagataaagacaaaaacggtatgtggggttggggaagcgtaattgctgacgagttcaatctaaataaaatttctgtagaaaatcgtgcgatggcaggacgtagtgcacgtactttcctcgatgaaggtcgttgggataaggtatacaatgccttgcaaccgggggacttcgttctgattcagttcggacataatgatgcaggagatataaacaaagggaaagcccgtgccgaattgcgcggttcgggagatgagagcaaagtctttctaatggaaaagacaggcaaatatcaagttgtttatactttcggctggtatcttcgaaagttcatcatggatgttcaggagaaaggtgccattcccatcgttcttagtcatacgccacgcaacaaatggaaagatggaaaaatagaacgtaataccgagtcttttggcaagtggacacgtgaagctgcggaagctacgggagcttatttcattgacttgaataagattagtgccgataaacttgaaaagaaaggtgtgaagaaagctgcagcttactacaatcacgaccatacacatacttctttgaaaggagcgcacatgaacgccaaaagtattgctgaagggttgaaaaagagtgattgcccgctaaaagagtatttgaaataatacgaaagagaatcctgtaaagatagcaaaggactaaagggaaatatagactatccggactgtttaaatattctatcttaaaaaaggaatatttaagcagtgcagaatggagaaaacagcatagcagatgaagaagaataaaaaagctccgacatttgtcaacacgcaaatcctcattcttatcatttatagagtttatctagcatttcacacctattttatcctacaacacttgcaagtcgatatcgattcagggattaatcttccattatgttattattttcttattcaaaagtccagataaatcagagaaaaactagcttaaaaaagcacatttatatcttcctcaccgatgaaggacaagttcatcggtgaggaagatagcgttcatcggtgaggatcaccctgttggtttaaacctaacgaactctttttccgttagaaaagacgcatattctgtctgatattattcacttttcgcctatatttctgcatattattgcacttatttatgcagttttttctctgattcatcaatttcgcaacggttattttctaatataatcttaaaaacagaacatctggacaggatatgttcatccccattcaagggaaaaatgaatgttcgtatccaacataatacagtcgcaaatcattgatttattccacggaatagattaactttgcctgtacaaattaaaagcctgccaatatgagccaagtgaaaggaataccatacggaatatccgacttcaaccggatgcggaacgaaaacttctatttcgtcgataaaaccatgtatctgccccttatcgaggaaatgcccagttaccttttccttattcgtccgagacgtttcggaaaaagcttattcctaagcatgatgcgtacttattacgacataatacagaaggataacttcgacaagtatttcggtgacttatggataggaagccgtccaaccaaacaacataacagtttccaagtccttttcttcgacttctcaaaagcaggctgctcactgccgggagcagatttgatgagtagctttaatgaatattgcagtatcatcatcaaccagtttgcccatgcatacgcatcttattatgatgaagatttcaagtcaacagtagaaagcattgaaagcgctaaagcaaaattatcatatatagaagtaaaggctaaagaaaaaggatatcctctctatctgataattgacgaatatgacaactttaccaacgtcatattgagcgaacacggacagaaaatgttccatgacctgactcatgccagcggcttctaccgtgaatacttcaagcagttcaaaggtatgtttgaccgaattttcctaatgggagtcagccctatcacactggatgatttatctagcgggtataatattgactggaatatatcgactgattcccgttttaatgccatgataggatttgatgaaactgaagtacgtgaaatgctccgttattaccaacaaaatggaaagctggtcggtgatgtagaagcgatgattacagaaatgaaaccgtggtatgacaattattgcttcgccagaacatctttggacaacgaccgtgtgtttaattgcgatatgactttatactatttacgtaaccaaattgattttcaccgtccacccgaaaatatggtagacaagaatatccgtacggattacagtaaactgaaaatgctggcacgcattgaccacgacaacacccatgagggaagccgcatgagtactatcgaagaaattgcggcaaaaggtgaaatactggtagacttacatacttcgttcccgtcagaaaagatagcagatatagagaacttccgaagcctgctctattattatggtttacttaccatgtgcggcacccgtggcgaccgtctgaaaatgtgcatacctaacaattgtgtgcgcgagcagtaccttggattcttgcgcgactactatcaacaggcccataccctgaatctttcacatctgaaagacttgatagatgatttcgccttcgatggtcattggcaaccattcttcgaaaccatcgcccgtgcctatcgggagaactcttccatacgagatgcgatagaaggggaaagaaacctgcaaggtttcctaaaagcctatcttgccattgcttcttattatctcgtacagccggaactggaaatgaactatggctattgtgacttcttcctattgccggacaaaatgcgttattccgatatagaacacagctatatcctggagttgaaatacgctacacgtacagctaccaatgctgaacttgaagcccaagcagaagaaggaagacagcaactgttgcgatacagtaaggataaagttgtgcagaaactggctactggaacgacacttcacctattattaattcagttccaaggttgggatatggtgaaatgtgaagaaataaatgcttctgctattcatccttcggaataacttcctgcatataaatagcatccaagctccaaagagcagcatcattcgtgctaatgctcgtacattcatctaatggagacggtacttccggcggaagtatggtagtgatgcggaaaggcggtgcaggtgtatgttccaaccgggtaaacaaatctttccaggcttcttcagccatttgggtattacgcaagtgataagctgcgtaagccatcaggcgggaaacacgaaaacggctatggctaagctcccatgctttcttcttgtaacgtgcagcatggtcaagccaggcgtctttccattcgggtatatcaatcatacgcatcatttcattggctatctcaaatccgcccatgatcgtcattaaatggttggttgtttccagtttggggtcacattcggttgtgatgatccctgttgacggatcaaatcctagagctttggggccggtaaaaaggcggttaggcagggcggcaatgcttttcattcctgctattattttatcacgataagttgtgttacctgtgcgctcccattctgtcatccaattaccggcataagccagccaatcggggccaatacgcaaacgggcgggagcagtacaaggatattcactgcgaggttgggccaggcgcatagggtccaagtcatagagtttgcggtcggcatccttcacttcagtcattaaatcaccgcaacgttcgtctgtagtaaggtaatagtagaaacggttccaggcggcctggctgattcgcgcttctttagctccgcatccccaatgacttacattatgccgactgcctaatccggcattgggaccgatatgatagacatccacttcgcctgtatgacgcgtcatagcttctgccatacgccaaatatcaatacgcccggtacgcaggaaattataccatagccacatattagaagccagttccgtattgtcccaggcaaatcctccgacatcgtaacgccaggtatgacgaacagggtcataagcgtgcatcacatcaccataattccagaaaccgtaccacttgttttgttcgattgctttctgatagaagtcaatgtaagcatccaagcggtcttctacacgagtacggaatggagtagtacggtcggggagactccatatcccgaaagcctggcgggcatgaagataattcggggttggcattaacagactagggctagaaaattgtttggcataatcagcaaaagccttttttccggcatagccactttgtgggatcagtgtcaacgtagttgtacgggcaatgccgtatggcgtgctcataccttcctggacatcttcatagctggcattcaggtcatgagctatacgatcataatgccgtaaatccataggctcggactccggactccacaaccaggcggtaagggtagctaccggggttcgtgcgtctgaaatttcaatagaagagggataagactgccaaaagtcatgcatacaaagtcctaatcctccggtaatatctccgacaaaaatatatccatcgctacgtgtgccggaaaaggttcctatccaaggattatcgttattggcacgtttacgaatggagaaagcatcggcagtgagttgagacagacggtagtcattccatgaagcccagttatcgagcagagagcggttcttttcatcgaaagattcataaggcggaatacgtttgccttccatttgctgctgttgcagggagggttcatcagtcggcatctgttgtgcatctttcttttcattactgtttttcttattatctgtcttatttaaagtgagtatgcgacgccctaccaatggttgtaccggctcgctccacactcctccatctgcacacgaaaaagcaatatgacgattatacagagcttcacgcataggaacatcgaaacggatacccaaactacgaatgaaatctttcttctgatctccgtcatagatgaagctatgtaccattttgatctgttcactaccaccataaaagtagagacgtaccacaaaaggaagccactcacggttattccgtttgttcatatcagagttattcgcatagttcccttccccttcagagtgattcgtatcaatcttcttattcctgttccgatgtatcccttccaactttacaagtgcccgtacagagcccagacgttctatggttactgattttatttctcctatgtaatgagtaaaagatatttgagatgtattttcttgaatcggctcgttttgcgtattacaaatcagacgcgctttctctcctactttagttcccttatataataggctatcaatcaggaaatctccgcgtcggggaataaatacggaaattagccctgtttcaatttgaatatcttcaggcgtttcagtgattgcaatagaagcattaggctgtttattgatagtttttgctttccggggggctttttctaatgtcagtctttctgttccggcaggaatgactccggcaactccgctccatttcacggaaccatccggccagtaagccaatggccaagtatctaccggaatctcttgatttctatctgtttttagtcgcaatgaagtttcaggaaataggtagccttcatcaaaaggaactccgaagcttacagctttgtcttgttcaggagtattgccgatccaatgtaaaggaacagtagacgtttggggtggtaaacattcatagtggaagtttgtaatgcgggtacgggataaggtggtgcgaaagccgaaccatccttctgtcagaggttcggcatcgcggaagtccaccagtctcttgccgtctatgtaataactaaccctattattttcatttgttatcttaatgtgataccagtgattcgcttttagcaaatgttcggtatctgtatattctttcaatatggcaggacgtactttgggatctgtgattcctgcttcattgccgtcataacgacggaagcgtgtagtagagttataatttccaccatatcccatgtaatagagttgcaaagaataacaattcagaaagattccgctacgccacttctcacgtttccatatattatcaggatatttgggatccgaagccatccaaaagcaattcaggtcactcaaacggtctccttctttttctacaactacacatgcatcatattcaatggttacccgcccgctcatcttttctttcctccataaagtaaggcctttaggagacagtatttcagcggtatcaccctgaaatgtcactttataatccggagattccgactctaccttccaatatttatgaaactggcgggcgttgaggccggaaactttattgttttgtgcgtttgttcctaaagtgatgaagaggaacaaaaggataaagagttttttcatatgtatatttgctatctcaccttacaaaggtagggagagccgatcaattaagaaatagaatattatccatatatatggcgattcgttcaactatgaaaaaaagaacaacccgacactgtaaccggattgttctttccttataaacttatactaaatagaataagatttttcttattctttcggttcttccgtttcggatgacttcaaagtttcggcgcctacataataacccaggttagttccctgattatatcccatgttctgcatagcctgagacatgtcatagttatggtcggtcatcaagtgtggcagacggtgtgtagtaggatgattcgttgagaatatatagattgatttataatcacttgagcctaaaataacctcttcacggtaatcacccaaaaaatcaccataataacaaggattatattttgaggcatgatttccctgattactaccataaaggtcaaaagatatcagacgattcttatttgacttgtttacatcagggttcgctttatagctcacaatacaaccgcggtctaacatttccctagtagattgaccactccaataaatagccacattatacatcactccgctaccaattccagtaggatatgtagtagaaaccaatccggtaccattacaactaaacataccttcttgtgtagaagaccaatattcaaaatccggactatccggatcaacatccgctactatacaacgcccaacatcacttgcatctgccggtaaatttcgtccatgaccggtaatcatactaccatctcttgcattcatcacctgacaggcatatccatttccctgaccttcataatcttttgactcttcaaaagaagcaacaatctgcaatccggaacggtcttttatgaattttccgacatgcaatatatctccatgcccatttccactacaccataactcgcttccattatcgtcaatagctgccgaaccatacaaaatctcatcccttccatcaccgtccaaatcagcaacacggaaacagtgtgaacacatccctaaccatttagacgaatgatctgctgtatcaaacttccaacgtggaaccaattcattaccttttaagtcaagtgcccaaacctgccaattcttataaatacctctactgattatcaaactaggattagccactcgcgctccggttgtttcatcaggaataccatccaaataagcaacaccgataaagaagcgatccatacgattgccaaaatcatctccccaatattcactccaatacttggcacgtgatactttcgatccttctcctccacgtggaatattatctatacgagttatttcacgtccgtcatatcccctgcaaatagagatatattcgggaccctccattatcaaaccgcaagtagtagctgtagacgggtcattctgatctctcgcaatagccgctccggagtaccaacctttaccatctgtttgacgattacgataatcattcactttcccatttgcgtcagtgataatcttgccatcggcaaactttgtaccttcggaagtacggaaagcaatttcacacaaaccgtcaccatcaaaatcatacaagatataagaagtataatgtgatccggaacggatgttaattcccaaatcaatcctccacaagaaagtcccgtccattttatatgcttccaacagagtagtaccattaaaccaaactcccatattcgctccgtcgtatggttctctcttcaccacaatctctaattcaccgtcaccgtccaagtcacctagctgaatatcatcaggagaatatgtaatcgatgcatcgggtacattcatgtttaatctaatttcatgataaaacttttctgccatttcagaagtaaatgtataatcgcaaagcgtttcagcctgattagcaagagtaacccgatatacattcgtttttgatacatcaatatctgcatccacccaggaagtcgtatttgaaataggttcttcattcaatttcacttccgtctcaccgtctactgatttataaatatcaaaagcaacattagacggatcggtcttcaataatctccagctaatcaatgcggatgcaatccctgatgcgttattgggatcagaagccgaaataggatcataactcacccacatggcgcggctacccgttatgacttcggtcggcagaggaggcaattcttctgtttgattgccattgttcacttcaacgacggggtcattatctgagcaagcaactatagccagcaaataaaacagccccaatattatataatgtatcttcatttctttcgttttttattctataaacatccgttctatgcaagaatatcctatttctattcatcagtattccggttaagttaccaacccggattctgctccaaattaggatttttcgatttttcactctgaggaatcgggaagaaatacatcttatcatcccaacttctttcttttaccttacgctcatacgtataaatatcatccccatttttcgtaattttcatttcaacaatgttcttgaaatgtttgtccccctccttccaacgacgtacatcccaaaaacgatgtccttcaaaagccaattctaccatacgttcattctgatatttcttccagaaagcatcattggtcatcccttgagggaatccgggcattccggcacgtgtacggactactttgatagcatctacagccgaagttgtaaattcactgtccgttgcatacggactacccagatacttatatacagcttccgcataattcaaatagaactctccaaaacggaacgtaatccatgaatgataggtctttgaagctgtaccggcacgcaaatctactgccgtctgacaatacttcttcagataataacctgtcggagttccgccactcaaaggttccgcatttaatccgccctgataggtttgcagaggaacagtattccagttaggccatttttcgtctccattcttggcaatagtcagatagaaacgagggtcgcggttggtataataaggattagtaggatcgtagttatccaactcgtccgggcgcaaccctgtatccttcatctcatacgcatccaccagtgtctgtgtgggacagtttccacctttacaattttccaaccctaccgggaagttatatccctcaaaagaattagtggtagtagtggcacgacggagaaaaatcaattcactagtagcgtcattgtaattatccttactccaaagtgatgaataatcctccactaagagttttgccttttcagcaaatccattactgtcatctaaaatttccttattggctttagctgcacgataccacagctctttattatcagtcgggttaaacaaaggacttgccgcatacaacgcagcacgagctttcaaggccaataccgttttacggttggcacgtcctgtttccgccggactactaggcaatgccatatctcccagtttactgtaatcgacaataatcttatcctttatatcatcacattcggctatgatataatcaaaaatctcctgtgccggcctgcgcgacaatgtattcgattcttcggctgttaatatatggtcgctaaacggcacatctccatattgccgtaccaagttaaagtagaaatatgcacgaaggaaacgcacctcatactggtaattggtataacggaacatttgttgtgcataatcactgttcaaagccaactcgggaaatgtcagtccggtaaacttctccagatataaattacaattggctatcccttcataacaggacgtccacatactacttttagcatttgacggactccaagaaccattgtaaaagtcttcaatctgatttcccgaataagcatattcagcctcatcagtagcagaaccaagaattgccccgctatagtttccaaagtccacatccatggacaaatagatatttgttatcagccctcccacattaccgaagttgagcttcacaaaatcctcatcatagttattgtactcatgatattccatcttatctgagcaggaaccgagtgtgactacacacatcattccgtagataatgtttttcagtttcattctttcgctttgtttttatgattaaaaaccaatcgtaacaccgactactacactcttattcagcggagtcgctacaccataacattccggatctgccacatcaatgtgatctgaacagaacaagtctgttcctctaacatataacttggcactccccaatatcttagtcttcttcatcaattctttcgggaatctgtaatacacctccgcattacgcaacttcaagaatgaccggtctgccaaccaaaccgtattagcctgatagttattggcattactctgtgaactcaaacgaggatatttggcattttgattttccggtgtccaacgattctcataataatgagtagaaagtgtcgtattatttatcaatggccaaaacatactcttcgtattcaataaagcagaatagttacctgttccctgaaacattacatctaccccaatccctttccattcggctcccaaatggaaagaataataaatttccggggctgtcgtactataaccaatagcagttttgtcattagcatcaatgattccgtctccattcacatctttatattttatgtctcccggcactaccgtagtaaagttttgtgtaaggctgtttgctatatcttctttatctttgaagaaaccttcagctaccattccatatacttggcccaaccgatttcctgtttgcacaagattcttatacaaacgcggttcttccagttgttccttaatttcattcttattccaagcaaaattaccgccaagattaaacactacatctcctaaccttttcgtatagttaagtcctagttccataccatagctatcaacgattccggcattctcgaacggagcatcaactcccagtacatcggtatatttaccctcggaagaaacccaaatatcttttctccgttgataatagccttctgccgtcacattcaatccattgaacaacatagcatcaacaccaacattatatttatacgctttctcatgtgtcgaattagcagttgccaagcgaccgataatagtacttccgaattcagagtcgtaactactgttaaacttatattgcgtaccggtagtcgtataaatctggtcccaatagtcatatacggtagtacttccgtctttaggcagataatcaacattgatcactccaaacgaagcgcgcaatttcaagaagttcacccaagacacatctttcaaccatttttcttccgaaagtacccaagcagcagaaatggtaggagaaaaagcccatttatgtcccggtgccaataaactggaagccgaaccaaccaatgccagatccaaataatagcgattagagaaacctacatgattataccaagaaacattttgccgataaatagtagtgttcagaccgtatgaatcacgatattcataatcccatttcaattgagaatacacatcccacttttggaatgaacgattataatctacactacctgcaaaattaaattgacgcgcccaattgtcaatacccgcacccgaacccatttcactggattcgccacctgaaatggcagtataaaacggcccgttagttgtccagcttgttgcataaccggcatacgtataagttttgctatgatcttccagaatattggaatagttgtcataagctaaacgaaagttagctcccaatcctttcagcaaaccagacaaatcttgtgacaaggtaaggtcggcaaacaaactacgagagtgtcctttagaataagcagctccctgcgattgtgcgacaggattcgacgtccccgcccaagtagtacttcctccccaactgccatcttccgtacgaaccggaaaagctgcagaaggaatcgaataaatcatatcccataggttaaccgaagcccccggaatccgagattcggacaaggtaccgagaagattcaacttcaatttggtagtggcggttaaatcaatatccagatttgtacgcaaattagcacgtgaatacatattttgtgtagaatatccgtcatttgcattcggggttttgataaaccctttgtctgttaataaattcgccatagtatagtagcggaactttgctcctcctccacggaattcgatcgtatatttattagacactcctctgtctttaaaggtttcatcaatccagttcacattaggatagagataagggtacatacgggaagcccctccactgcctactccattacggaaagcatcgacttcttccggagtataccgagctcccaaaccttcatatccacgcgcttcattcactgcagaagcatacgtagccgcatccacaaattccggacgtcgagactgtgtgttaatgatatgatcatacgtaaaggttatctcttttgttttgtacttaccacgcttcgtcgtaatcaagatcgcaccgttcactcctttgtatccgtacaatgccacagccgcggcatctttcaggatggaaacggattctacttcttccggactcaccaagctcatgtctcgttccaaaccgtcaaccagcacaagcggtgtactacttgacaagctctgcaaaccacgtacataaaaggtaggatctgccattaacccggtactgaccgcattctgcaaagtagtaaggcccaatccatatccatataaagaattggatatattccgggaagaccgcttattaaactcttcattataggtggtagaaactgctgccgttgattcatgacgattgaatgtccggttagctcccacatcaatagtctgagctgcatatcccatcacaatggtcatcggaccatcagtctttgccacaactgtggtagagcctttgtcgacagaaacgacactcaagcgttgtcctttctcgaccgcaatctcgaatttaccatctttatcagtttcaacccgggtctccactgcgccaccttccacattaacggacgctccatagactgggtttcccgatttatcaacaacaatacctataatgttgttgtctgtattctgcgctctgaccggaatgctcaaacaaaccagtaaagccagtatcagaatcttattttttctcatataaatcaatattcaatattgttttaatctatttcgctgtctcacattaccaacccggattctgaatcaatccatatcctttgttaatttccgtttgcgggaatggagaaagataccatttgggatcaaatccgtatgtccaccaacgacggaccggtttggataactcaaacctttcatattcaaaacgagtaggctgcaatgctcccttgttcttatctccttcattccatttagcatttcccgttatacgattaccggtatcatccaaacgataggtgagcaacccgtgcaggcgcttctcgaaacgatcggcacgtttgtaacggataagatcaaagtaacggctatcttcaagccccaattcccgaacacgctcgcacagcaattcttccaataaggctgctttgtcagaaagtaaattcttatctgtaacacactccgccaaatctttcttcaatcctacacgggcacgtactatattcatttggttaatagcgccccggtgatcattcttggcttgaagcaaggcctctgcataagttaaataaatgtcagataaacgaagatatacccaatgcgtatactgacgttggtactctgttcccaaataatatttcatatttttataaccagtcgcatagttacctgattcaagcgctgcattttgtccttcatcgtatcctccgacccacagttcataaggtaaaccggacattgttcctgcactccagtctaacatcttcggcaatccgtttaccatgcaatgctcatacagacgaggatcacgggttaatacgatttccgacaatagttgttctccatttttgaatgttccggtcaggaacattgcatccaacttaccttctgtttccgcctttttccagtcaaacggagtaccgtcggcccatgggaacatctccacatattcctgtgtaggcggatattcggtacgacaaagtgacggaacagcccaggaatgccacatataagaacttgagttgaaagcgtccgacatattcgtgcggacagaatgcaagacctccttgctgttctgacgaatatatcccatacgatatgcctgccgatactgttccggtgtttcttccgaagccttattcaggctatacccgccttgactctccagctctttaaagaatgcttcacaagccttcaaacagttatcccaaagttccgcatggtagccgccgtaccataccagatgctgctgttcagcctctgagtttcctcctgcatatccgttgacatcgttaaacaacggagaagcggcaaattgccagattttgcatttcaatgccatcgcaccggcctttgtccagtgtccggccttgctggcaagatcggcatcagcataagcccacaccaatccaccggaattgatagcatcatccaacatctttatcatgtagttaacagtctcctctaccgtagcacgggggatttcataacctgactccgtaccggtgaatgaagcatataacaatggaagacctccataatgacggaacatatcaaaatagcgtgccgcaatcaggcatttagcttctgccaccaactgagttttttcagtgctatccatgcccggcactctatctatattttccattaacaaccagcaccagcgcactacttcccataccatttcccgtgtatatgggaaaatattaccacgcgtgccatagttggcattgagagaacccaaataatactgctgatatacagttgcgtcactaaaataaagtgaccagcagtctgttagcgcatccttctttcctaaataaggactggaagaatcaggaatattaccgttactgtccgtattatagggtaatccgtaatactgtctactgtaacaggtgttcaaaaattggcgcgtatattccgcactattgaacactgtgtcaatagtagcatttccgcccggtgccttatccaaaaaagagtttccgaatttaatttcgtccacacatgaagtggaaaccaaacaaactgccgctcccaacatcgcaccgatgaaccatttattttgtaatttcattgtatctttcctttatctattttagaatcctaatttcaagctcaacgtataagtcttggacaatggataagaaggtgcattagtagctcttgcctccggatcaccccacaaataaggtgtaatagtccacaaattatatcctgcaaaagccaactggcatgtattcagtccaagtttcttcatcaatgggaagtgaaaattgtatgccacctgaagagttttcaaacgcaggtattttgcatctttctcatataaggtggaggtagcatagttattcttcgcattgtcaatggtagctctcggatactccgaagattgtgacggattttccggtgtccatgtatggtccaaatggtatgccaacaatcctccctgctcgctattggaagatgaataaaacggttgacgaaatacatccgaaatcatacgacttacattccaggcccctgtccattgagtacttatttccagattcttccaactgaatcctaaattaatacctagcatatattcaggatcgtctgtaaagccatagtcataacttgcatcatttgcatcaatcttacggtcaccattcaagtcaacatatactgcatctccattttgaagaatactctcgtgagtggggaacggacgattaaatgtctgctcatatagcgcaggtgtatcctcatcatagaagcgccagaaaacatattgactacgcgaaccgatacggtgtcccttctgatattgatataaattattctgcggtgcttccttcttttcaagaatctcattctgattataagaaaggttaatacccgcccaataacggaaattatcgccaatcttatcgttccattttaaagaaagttcccagccccaactgtctacacttcctaaatttgaatagggagtaatgaaccctaacattcccggagctgtaccgtcacgcaaaaggatgtcattacgacgttctttataatattcaaaggttgttttcagacggtcatcaaggaagttaatatcaacaccatagttccgtttcagagctttttcccatgtcacagcagggttattcttagctacctcacgcgcacccagactaacagtaccattatctgttccgaatccatatccccaggcgttagttgctcctccacttgccgttacacgatttgccaagtcacctaaaccgacattatatggatcagccatatacataaaccgcgatcctccaatattatcgttacctaccaaaccgacactggcacgtaatttcaagaagctaaccaccgacttcaaaggacggaaaaacttctcttcactcatcacccaacctatagaaccagccgggaaataagaaaagcgcaaatcggacgcaaagttttccgaaccgttataacccacattaaactctgccatatagcggctcttccaatcataagtgacacgtccgactaatccgacatatccatgaggaatgtccgaatataatttcggataatactctttctgttgattatacaaaactaaggctgtcaccgtatgatcaccaaaagtacgattataattaaagctggcttccatataccaattacgtgctttgcctgtagtatacgaatacttcacatctgtattctctccaaacttacgataagcaatactaccgtcatccatcaatacaggagtgtatgtagcaatagacccaccagaaccgactttattaactgtaaacgagctgttataagatcccttcactttaaaagaaagtcctttagtcaagaagtccattttttgatccagaatcacatccacattcagcgaattgttgctggtctggctgaacccatttccataatatcccatacctgtacctcctgtaaatggtaatttcagtccgtctgaataagtctcatcgctcgaatttaccaattttccatctatgattcccggactggagaaaggagtagcataatacatatttttaatcaatccggaagatccctgactcgtacgcggttgatctgaattattcacattaccactaatattgaatgacaaagtagtcgttttagtgacatccatatccaagtttgtacgatagttaaaccgacggtactgatagcttaaattataaggaagatcaaactcactaaaaagtcctccttgcgtataagcacctgcagagatgaaataacgtactttatctgttcctcccgagatgttcagattatgctggctctgaagcgtagagcttttcataatatagtcagcccattgtatatttgggaaacgaataggatcggaaccatctgcaaatttttgaatcacgccatcactaaataaggcagatttgccatcaccggacatcatttgattatgaaaacgggcatagtcataggaacttgcctgttctaccatttttgtaggcatcaatacagaagcagaagtagtaaacgaaattttcgcctttccttcctttcctcgtttagttgtaatcaaaatgaccccatttgctccacgaataccaaatacggctgttgccgaagcatctttcaagatagaaatggattcaatttcattcgggtcgatatcactcatactttcacgatccacaccgtctacctgaattaacggtgaagaattttcccaagtagctttaccacgaataaaaatttcagcggcatccgctcccggctcaccggaatattgtacggtagtcaaacctgtcatctgccctcctaatacattggaaaccgaacctacagatacacgggtcaattcttctcccttcacactagcgatagctcctgtcatggtcactttcttctgcgtaccataagctacgatttccacctcttcaagtgctgtcacatcctctaccagaatgactttcatgtcatttttcgctactacttttttatcggtataacctataaaagatactttcaatttcgcaccgggacgtacatttattctaaatacaccgtcaatatcggtaattgtaccattagatgttccttccgcaagtacacttgctccaattatcggttcgccttggctatctactactgttccttttatagtactttgctgctgtacaacttcgatggctgccgaagctgtttgcaatccccatgcaggtgcaaaagttgctatagtgaaaaacagagcgacaggtaaggttgtcccctttataaagtttttcttattcatatatgtatatgttcatgatataagtataattttaacggactttatataccgtcattattttagaatgcaagcatcatacggaaataaccggcacgcgaatcacgttcacaaattatgtgatatcttccaccagccataccgtgtgtccattggttggctggagaacgctgtgtgctactccaatagtgtccactgttagttcctgactcgacagaggtcatctcatcaccatttacattcttgagacaacggttaataacactcaaattcttagcgactgtatcccaacacattatagagggcaaataccaaggagtcacatttgccggaatagcttccgcttcacgataagccttgatatacgcataagcatggtcgcaagtagaaggactacccataccttcgtaacacatagtaagtaactgtgtattattgtatcccattagtgctgggaaaaccaatgaagcatcattcttgttaacatccttctctgtgttacaacctacaaacttgtttgcccaattctcatctgaagtaaaccagtctgaataataaccggacttacttgaatggaacattttcaaagcaacatcattttgttcactatcttttaccacagaattcttaatagatagcactataccgtgcgtacatgcagggaaatcgcgacgcaaagcatcaacttctgctgaatagagttcagtatgtgttacactgggttgtgaatttcctacataacatacaataccaatcacattctccggcaccgtttccgcatctactgaaactatttttccatctgcacaaaaatagtctcctacctgcaaagtatggttgattttacttttatcttcgatggtatacattttcgccgttcctccttccagcgtacctttagcttcatattccatctcacttactccagaataagtacccttaattgagaattccttcttcggattaaccaagaaacggtatgtatccgtactttcctgataataaggagttgcttgagtattgttcactgtaaacgaaccggctgttaatggtaacaaataatcatctataccgccatttgtaaagctataggtcaaattaggcatcttcactaccgcaagagccatccgatgttgcatagtaaaagcgatctgtcctttcaaacgatccccctgaacactacccgtactcgtcatcaaatcatattgtgtataatttccttcattttgttcactgcctattttccaattgttgacgtatgtttcaaaaggatccaccttcgtcggatcaaaagtcacattcgcattatacggatagtatgcataaaaagtcatccgctgaaattgtgaacctttgtattcaataggatcccctccatcagtcaattcccaatagccatctgtcagtgtgaatttccgattcttgatatcctctaccaccgtttctcctcttaccgcaaatataccgatagcatctccgttagaaaatcgggtagtatatccattctctgtagcacgtgtcttaccactttcgtccataaatccttcatcagacacactaatctgaaatccctgcaaagaatccggtgtttctccggtgagttcttcattttgcgagcaagacgcaactatggctgcgccagccagaaaaagcattgatatataattatatattttcataaatctcatgtttatatttttagcatttttatctatattagattggtaaacagatcacttcacaacaggctgtggagttacggtttcttctgtaatattccaactaggattagttatctctgttccagtttcagctatactcgggtcggatgttataggatcgtggttttcatcctcccatcctattatttgcgtttgttctgtaattgtcaacacataattattgtcctcgtatttatttgtcttgatgatgtaattataagaaaatcctgatttcaattctgtcaagttagcaaactcggcttcataaagataaccgttcattctagcttggatagttactttgccttgcaccttctgtggcagtaaaatagcttgtactgtataattatcctgctctcctattttatcccaataaatatcatctttatccgtaacagggtcttcactgactgttgtctcccctgttttaggattaaatgtaccattattcttaagcccaataagataacaagttatatctgccaagtccacaccttcgccagcttgaaactccaatctaatacgactcatcacatgattgaatgctaatgtcacgttcggggtttgtgatgtagccttccctttagcaaaaagaaaatctatcttcgcacgttcttctgctgtagcttgattgtcactggctgtagtcacttccaatacaggttgttcttcacctgatgtaccagaaaatggagcgtatgccactacatcatactctccggaacctaatacccaaatctcttctgcatttcctccttttgccgcaaaaagaccattgcccttgtatttgtaatgaatattcacttgttccgtaccacaagtgattcctaccgagtcttctgcctcccagtttgtttccgtagctcttgtaacaagattgctagcctcatgattgtttattactgcactaaaagaaactttcgctcccgtatcaccggtaaactgaatatcagtttctttaatatcgttgctacatcctgctaaaagtagtaaggcaacagcagttgtgacatagttttttttcataccatgttttttaaagttaaacatatttttgttgattagtaaaatcgtcgtaaagtaaaaaagacaatggctgcattcttttccaagcagcaattgaaataaatgaagcattttttttattgttttccatatctattaggtacatctgttaagttaaacaaaagttagattctctttttaaaagtaatttttcacactctacctgtaaaaaaaatacgaaagttataaatctaccctcaccaaccctcacctttgacccatatcttataataaaaagataacggggaatcttaaaaactcaatcatctttttcagatttaccacaacgtttccagaatactccattattttattcaaaacggtacggaaatgagtaaaatcgtgtgggaatgagctgaaatataatctcacaacactttactagagatttaaaaaggttcttaatcaaattccgtgctagtaaagctcattgaaaggccgatggataaagggatatcggcatattagaaatagcaaataaattatccaaactatatgcatcttaaagtactccggaatagccatgaataaggtaattgaacataaataagtagcacggaatttgaagaagaacctttttaaatctctagtgaaatattgtgagatcatatttcggctcaaatcagtgcaggaatgaatctaattttagggatatggctgtgctaaaccaaatcctccaagaattacaattgagtcggcttgttgaatatacataacttccagcatttatttccatatttccaccacatttaaaaaaatatgtatatctttgtcatacggtttctgctcatcagcgtgatgaaattagtagaaagcggtatatattactaaatggaatatgtaatgtattgtctctcccactcgaaacttagcaatttcatatagaagagagatgattcaacagatattccacgcgaacggctttatatcaacatatccgttggagatgtgttatatataaacgattggcgtggatgtctgttgttatcattgtctttctatagggtatgctaagacctcgagtggagataatggtgcaacagcattcacgtcttttttgtgtccggtcggttatgattaccccaaaagtctaacctaaacaattccccgtccgcccgaaatacagaaaacgtgaatgcccgttgctccacataaacaaaataatactccatttttattgtggaacacattaaaacaaaagcattatgccaaaatggattagcgtagaagaagcggcggccaagtatggaatcaacaaagaagtaatctggctttgggcggatatgaaaagattcccgatgtcgtatgagaaaggtatcaccactgttgatgaagaaagccttatcggattcctgcatcagaataaggatcgagttacagccgagtatatcgacacattggaagacctatgtattgaaaaagcaaatatctgtaacttatatgctgaaattattggctgtcaagacaaagaactcttgtatcaaagggagcaaatagctcgaatgaaagagatacaaacagctatgaaaaggcaaaacagccggctccgggattgtgagaaagtgttcacgaaatatgaagagaactttagtacctgctggattggaagaatctgcgctcacttaaggcggctgatacggttgatacgacggtaaataccattttatctcattttaaaccctgaatagatatatttaaagatatccctaaacagaaatgtttaaaaatactagaaatatactgtagtaagattttttatccattcgttttatattcttaactccgaaaaattcgtaagtgtagataaaccaactacttttggctcccgaatttgcagcatttttgaatgtcttgcgtctaataaacataaactaatatatttctagtcatgaaacacagactgttactactaattctattcgtattcgctacctccgtggcggggtgggcacaaaaatccacagctccttcttatacagtcaaaggagtacttattgattctttaacacaagagggagaaccgtatgctaccatcaaaatagcaaagaaaaatgctccggataaagcagtcaagatggcggtgactggggcgaatggtaaatttcaggagaaactgaatgtcgctgcgggcaattacatcatcactatttcttcgattggtaaagcgccgatagtaaaggaatttactctaaaaccgtccgtgaaggaggttgacttgggcacaatgatttcttcggaatccaataacgtattgaaaggagtggaggtaattgcacaaaaacctttggtaaaggtagatgtggataagattgaatataatattgaagatgacccggactcaaaatcgaacagtatattggagatgcttcggaaagtgcctttggtaacggtggatggagaagacaatgtacaagtaaacggcagtagcagtttcaagatacatgtgaatggaaagcccaataatatgatgagcaataatccgaaggaagtactgaaaagtatgccggcaaacacaatcaaatatattgaggtgataacttcaccgggagctaaatatgatgcggaaggtatcggaggtattctgaatatcgtcacagtaggttccggatttgaaggatacacggctactttcagaggaaatgctaataataacggagtaggtgccggcacttacgcaatggtgaaacaaggtaaactgactgtttctgccaactataactacaattataataatagcccgcgcagctattccaatagttatcgcgaaaactatgaaccggataaagagaatgaaaaatatctggaatcggaaagtagctccaagtcgaaagggaatttccagtatggcaatttggaagccagttacgagattgatacgttgaggctgctgaccgtggctttcggaatgtacggcagtagtgacaaaagtaacagtgacggaaatacaattatgcacggagctgaccgacaggattttgcgtaccgttatagaaccgacaatcatggaaaagggtcatggtattctatcaacggaaatatagactatcaacgtacttcccgaaagaataaagaacggatgattacgttttcttataaaatcaattcccaaccccaaacgaatgattcatataatacttatctggacatcgagcctgatgagaataaactggatatcattaaagaattgtcattaaagaatttccattcggatggaaagacaaatacgatggagcagactttccaggtggactatactactccgattggaaagttgcatacaattgaaaccggtgccaaatatattttccgacgtaactccagtgataatcggttttatgaagccgagggagcaagtgaaaactatgcatataatgagaatcgtagtagcgagtaccgtcatttgaatcatattctctctgcttatgccggatatacgctgaaatacaagggatttactttcaaaccgggattacgttatgagcaaaccatacaagaggtgaagtatctggtgggtccgggcgagaactttgattcgaattttagtgatctggttccttccgtttccttgggaataaaactaggaaagacgcagaatttgcgtggtggatataatatgcgtatctggcgtccgggtatctggaatttgaatccttatttcgataatcagaatccgatgtttatcaatcagggaaatccgaacctgaagagtgagaagagtcattcgttcgacttgtcttacagcagttttacgtccaagttcaacatcaatctttctttgcgtcattctttcaataacaatggaattgaaagaatcagccgtttgattactgataaagacggagaaatctttgaaggtgggcataaagctccctacggtgcactgtatagcacatacggtaatatcggaaagagccgggaaacaggattgaacttttatttgaactggaacgcttctcctaaaacgagaatttacgtcaatggacgtggcaattatagcgatttgcggagtcctgcccaagagttgcacaattatggatggaatgcttctgcttatggaggaattcagcagaccttaccgggaaaagtacgtttgagcctgaacggtggaggtagcacaccccgaatcagtttgcagggaaaaggttcaggatatagttattatagtttgggattgagccgttctttcctgaaagaagaacgtctttctttgaatatttattgcagcaatgttctggagaaatacagaacttacaataaccacacagaaggagctaactttatttcgaagagttcgagcaaatatccgagccggtattacggtttcagtattagctatcggcttggtgagttgaaagccagtgtgaagaaagccgcacgaagcatcgacaatgacgatgtgaaaggtggcggcggaggaggtggaaacaccggtggtggaggtggtcagtagaccacttccgcacaccgggattccctcttatttctgtctcacgtcttgcttgttggtgttaaaaccaagtttggttaacccggcctgtacgtcgggatggctcatgaagagtttccacaataatccgctccggtagttttcgatcatgacagcaataggaccctggtcgatagccagataacgttgcggataccaattgtccgtttcgctgaaagcatcgtagaatccgaaaggaccgaacactttatctcccataccatatagatggcgcatcacttgcatggaatattccggtgtatagataatggatgaaagcgcggcggtaggggagattactcctttgtcctcctgctcattgggcgaatgagccgcatatccatcgacggagtagctggcggtcagtccccaacaatccggtccgaaacctttgtaatgtttagggttgcggatgcagtaagcacggttcaccagtgtcaggttgcgcatttcgtggaagtagctggggcagtattcatctttcagtcccaccggatcaagtccgagaaaagagtattgagcccagaaaagcggtccggcttcggtgccctgatagcagaggtgcaactcgattccttccactttatgcggagaaacgatggctccgttctgtgcccaaccgtcatgatagacagccgcaggtactccgtgtgtaggagaagcggcggcaagaatatacataatcatacattcgttgtagccgtgtacagggaaattcatttcccagccatacgttggactccaatgccagtaaagaacgttttgcccgccttgccgataccagttccagtcgacatcccgccaaatctggtcgatacgttgggcgagggctttctctttctcgtttccgttgacgtaatattggtgtacggccagcagtccttggatgaggaaagcggtctctaccagatcgcccccattatctttctggccgaatggtttcaccttgcccgtatcaccataccaccaatgagggtaggctccgtggaaacggtctgccttttcgaggaaagaaacgatgcgttccattcgtgccagtccctcttcgcgggtgacgtaaccgcggtcgattcccgcaaggatagccatgatgccgaagccgctgccaccggaagtgactacgttggcatcgttttctggataaacgccgtctacatgataacgttcgggagctaagccgctattcggctcggcaccttcccagaaataaaggaaagtccgtcgctggacggtatccatcagggcgtcgtccgataacgagtcggtggctgcggaaaggttattgcttttgcttttccctttacagctctggaaagtcagggcaacggcggatagaaatagtaacatgagcggaagtgcactcatttctattattcttttatatttatcgttcataatcaaggtgataaaagtttagtttaacgtgaacttcgcggttttcacatcacggctgttcgtaccgatcatcacttcaaagtcgcccggttcggcaaccagttgcaagtcataattatagtatcgaagcatttccggagcaatcttgaaacggacaatcttcatttctcccggttcgaggaatatcttttggaaacctttcagctctttgacgggacgggtactgctacccacaacgtcgcggatataaagctgtaccacttccgagccgggccatgttccggtattggtaacctccactgccgcggtcaacgaaccgttcatgtccatggaagaatgactcaagtcgatgtcgctgtaagagaacgtcgtataagaaaggccgtaaccgaacggataaagcggatcattatccacatcaagatagttgctgcggaatttctcgaaccatttgccatctttcaatgggcgtccggtatttttgtgcacataataaagaggtatctggccgacattcttcgggaaagtcatggtcagttttccacccggattgacgtaaccgaagagggcgtcaccaatggcgtaagcggcttcactacctccgaaccatacattcagaatggcaggcacatgctcctgttcccagttcagcgtaagcggacgtccggtaaataacaccagtaccaccggtttgcctgtctttaaaagttctttcaacagattctgttgtacgtcgggaatattcaagtccgtacggctgctgctttcaccgctcatttcagaagattcgcctagcgctgcgatgatgatatccgaccgacgggctacgttcaatgcttcgtccagcaactgctggtcggtgcgattgtcacggttcagggaacggccgaacatcgttgcccgttcttcgtaacttgcatcactaatcaggttgcttcctttagcgtacatgatattcgcttttccggctgtcatctctttcaatccttctaccaaagaagggcaacggtcgagcacagctgctacgctccatgtacccggcatattgctacggctgtttgccaacggaccgattactgcaatatttccttttgggttgaaaggcaacaacggatttccgttcggattaccgtcgggactgtcattcttcagaagaacgaaactttctgctgcaattctgcgggctgcatcacgatgggctttggtaaagatgtcgcgtgccggacgtttcggatcgcaatatttatagggattatcaaacaatcccagtttatatttggcttccagaatacgacggcaagccgtattcaatgtttccatagagacttttccttcctgaacggatttcttcagtgtccctacaaaaccctcgcttaccatatccatatccactccggcgttgatggcacgggcggatactgtctgaagatcgccgataccgtggtcgatcatttctgaaattccggtataatcagtcactacaaaaccgttgaatccccactgtccgcggagaatatccgtcatcagccatttattggcagtggccggaataccgtctacttcattaaaagaagccatcacgctgcctacacccgcttcaacggctgcttcatacggcagcatataatcattgaacattcgttggcggctcatatccacggtgttatagtcgcggccggcttcacctgccccatatagcgcaaagtgttttacgcaggccatgatttcgtcattccgttccatgtttttcccctgatagccgcgtaccatcgcttcggcaatcatggcaccgagaaacgggtcttcgccactaccttcggatacgcgtccccaacgagggtcacgtgaaatatccaccatcgggctgaaagtccatgagattccatcagcacttgcctctacagccgcaatgcgggcagactcttcaatggctgtcatgtcccaggtgcaagacaaaccgagcgggatagggaacatcgtttcgtacccgtgaataacgtccatcccgaacaataacggaatacccagccgggaatcttccacagcctgtttctgtacttcacgtattttctctactcctttcagattgaacaatcctcccacttcgcctttcttgatttttgcggcgatgtcgctgcttttagcctgtcccgtagtgatctctccggtgacaggaagatttaactgtccgattttttcttccagcgtcattttattcatcaatacgtcgatgaaacgatccatatcctgtggcgacttttgtgccgacgcggttagaaaacctgcggcaaacaacaggacggatagacttaactttttgtatatcatattattatagttacttttatctctattcatataaagtcctcctgatgcgttgaatgttcggcaccgaggaggacattgttcgacaccgaggaacagtagtttcggcaccgaggaaacaaccgttcggcaccgaggaactttcttattggtagtcggggttctgtactaacactcccttagacttgtcgatctctgtctgtggcagtggaagcagtgcgtttttgtcctgataattggttttaccggctgcgcgcaacacttcttttgcaatgccccaacgaacgaggtcatagaaacggtcgaattccaaccctaattccacacggcgttcgtggcggatggcctcacgcaattctccctgatcggtagtcgtcactttaggcaatatattgctattggtgcctctggcgcgtgcgcgtacttgttccaaatagtcgattgcttcacccggaatacctttttcattagctgattcggctcccatcagcagtacatctgcgtagcggatcagacgaatgtttacccagaatcctttgttggtatattctttacgcaatgccgggtcggtataggctttcttattgaaataagcacccattgccggggaaaccggagactcgccgtatggttcgttggtgttttccggtgtgataggatcgctgtccgagtggcggaagtagagtagggtagagtttttgcgtggatcaccctgttcgtatgcttgcgccatatactctgttgccatgtgccatccccatcccaagtcccattgacctgctccgcgtacaccttgtacttcacagaactggctaccgataacggtactttgaggaagagcggcagtagctgtacattgcaactcgaatatagaacctccgttattttcaccatcatccgtgaaaatctcattatacggagtctttaagttgtagagcccctttttgatgacgtcggtggaggctgtgtacatattgttccagtcgttgcgcatcatataagtacgcgcgtgtaaggaacgggcagctccccaagtcagtcgtccggtgtattcgctgctccatgtttccggcaatgactcttctgctgttttcaggtccttgtcgatttgctcatagattttatcagcacttgtcttcgggatattggcttccgaagcatcgttgattttataagtcaccaaaggaacttcgccgaaagctcttaccagattgaagtagcaataagcacggaagaaagaggcctctcccttattgatgatgtcttcagtttctgtttgtccggctgtttctttttctgcaatggcatcaagaatctcattacattggtagatgatggcataattctgtccccaataagcacccagtaggccgttggtcggtgtatacacaaaatcatcatacatttcggctacatcagagccatcgctggcaatacttcctttttccgaatcttccgaacggaaacagtggatggcaaaagcaggagggccggctgtcacattatagttacgcatcatcgtatagacattataaatcttcccgttgaccagagcgttcggattatcatcttccgtaaactgtccttgtggactacgatccagaaagtcactacagctgcctagaaataatgtagttgaagtaataagggttgcaaatatatatttattcagtttcatataatgatagttttaaagattaaagttgtgttccgcatggaaaactggcagtggcaccttgtcactagaatgttaggttgataccgaaggtatagactgcaggtacaggataactgccgttatctactccgaatgcggtggcagttcctccaagttcgggagtatatccggtgttatgtttccatgtcttcaagttctgtatgttgacatagactttcagagcttgcagacgtattttggcaattaagctcttgtcgaacgtatacgctaactgtacgttgcggatacggaagaatttgccgtcctcaatgtaatagtcggagttgaggttgttgatggaatgtttggtgttcagcaacggttgggtgttggacgtaccttctccgtgccagcggtccaagcgttgttccaggtagttgaactgggcaaaattgtagttatcccatgtacggaaaatcttgtttccaccttgtcccatcatgtcgatgcctaacgaccaattcttgtagtctactccgagagaaaaaccgtaagtgacctttggagtcgggttgcctatcatggtacggtcttccggggtgatttctctgtcaccgttcacatcggcgaatttcaggtcaccgggggtaacggtagccagtgtatttttgggtgatgcgtcaatatctgcttgtgactgataaacgcctgccactttataaccatagaaatatccgataggataacctgccattgtgtaactttgctgcttatctccggcaatgatggaatatccttcctgaacaagactttttacctcattcttgatagtagtcaggttggcactgacggaatatccccagtcaccaatctgatcgcgccaggttacagccatttccactcctttattctggatctctcccaagtttccgataccggggatagttccggaaattccgggaacttcggctaacaaatctttggtattcttcttatagtaaacaccctcaaaatgcaagcggttgcgaagcaggttcgtttcaaatccggcttcccaggcttctactttttcccaacgcaggttaggattaggaagataggcaagctggtatccgggataaatgatggacggtttaccgaatacagccgaataagcattggtcaataagggttcggcaggataggctttatccaggttctggtttcctaacgtaccgtaagatgctttgattttcaacatatccagccatttgatgtctttcataaattcttcttcggacatcaaccaacctccacccagtgagaagaagttctgccattcattgcctgtgtaggagaaagcggaagaaccatcccggcggaaagatccgttgaacagatatttacctttatagttgtagatcacacgtgcaagtacggataatgtactgcgttcccattgagtacttccattggtagcggtagccgcatcgccgatgctaacaaaccatttgtccggattatccggaataaccagtccgaccccctgcttgcgtgctccgtccaatcggctcaacgaattataataggtagtaaaaccggcggtagctgtcaggttatgatttccattatcaaagctgttggtgtatgtcaataaatagtcgctctgaacttttgtttcattctctttaaactggctgacctcggtcttgcctgttcccaaagtagagatccctccgttgacagcggcatcgtatacttttacgatcggtgtatacgtccgtccgttgttcgacgcataatccatggagaacattgctttgaacgtgaaatgtttcaggaagtctacttcaccataaatattaccggatgcccggtagttctccgctttggtagtattcgctttcaattcgacgtctaccatcgggttgctaatctgcgctttctggaattcgggcagagccgtatataatccgtattcgttgttatacaccggagcgataggagttgcacgcagggcattcaacacctgtttggaatcggcaggaagcatacgtgctccgttgaattggaaaccgacttttaaaaagtccgtaatcttataatcattacttgcgttgatggttaccttgctgaatttctcatgctcgatgttgccttgttcgtaagagtagcctacgcccagatagaaactgtgtttgggcgaagcccctgtaatactgatgttattgtttgtaatgaaagcagtctggaaaatttcgtcttgccagtctgtattggcatcccagccggtataatcgaaaggatcgtctccttgattggcgagctgttcgttatatagttccttgaattgtgaaccattcaccagtttcactttatccaccactttcttgaaaccgaaagaagtattgatattgaccagcgtctgcccctctttggctttctttgtggtaatgatgatgacaccattcgcaccgcgaacaccgaagatagccagagatgacgggtctttcaggatttccatagattcgatgtcctccggattcaggaaattgatgttgtcattgaataatccgtcgacaatgtacagcggtttatatccgttgatggagtttgttccgcgaatacgtatttccggatcagatccggcccggccggagttgacaatctgcacacctgctacctttccctgcagggaagacagcggattcattgccggtttgttggctaactcttctcctttgatattggtgatagaacctgtcaagtctcttttctttgcactaccgtatccgataacgactgtttcggctagtacttgtgaatcttcttttaaagtgacattgatgacgttctgtgtccccactttaatggtttgcgaagtcatccccacgtatgaaaatgccagtacgtcctccggagtgacagagattgaatatttaccgtccatgtccgtgatggttccggtggaagttccttgtacgagtaccgatgcgccgatcaatggttcattggcagcgtccgtcactgttcctgtcaccgtctttgtctgtgcaaaggctgatgcagaggccagtagcaggcaaacaagcgtcatgatgctctttgacctgatggcttttttctgaagatgttgtaaaagtctagtcctcattgcattaaatttttccatttgttattatttaggttgaagtcttttttctgccgtcttttggcaagagtaacaaaggaaacaaacgaaattcaaaaaagattttggaaaaaagagggaatggttgattttaacactaaaagagaggtgactgttgaaaaaagtcaggcacgaaccggtgttgttcgtgcctgaataataggatgaggattctccgtcgggggaggtatatcctatgtatacgttgttcgttttatgatttcctgttttaaaacatctgttccgcagtggtcatacattgaatgacatcttctttgctgccattgaaaggacctgatttctctatttttagagttgacatggcggctgcaaaacgtcctgcttcttcgatgccggcacccgatacccgttggtatagatacccgatggtgtaagtgtctccacaccctgttgcatctaccacttctttgggtttatatgccggaatacgatagaagtcttttccgtcgaaaataagtgatcccatgcttcccaaggtgacaagcacttctttcacgccccattcatgtaattggcgggcagcttcatgcggatcagaaagacctgtcagcacttccatctcgtgctcgttgactttcaggaaatggatatattgcagagcctcccgcttatctgtccaatccaccggatagacgtgagtgtcacgcacttcacgtaaatagccttgtgagtctactgcaatcaaccctttttgagatagttctttgattacttccaacgagaagtcgtctgccagcagagagccgagatggtagatttgcgcatctatatctttcagctgaccggcagtgaacggatcggctttcgctaatacacgttgagtacggtcgtccggattggcgccatagatattctcgaagtatacggaatatttgcttggcagggcggttacatgaatacccatttcacgtagttgctccacgacgttcatttcagtggcaccaactgctgttactaaagcgtaattgatgtcgttaaaatggcggatggcatgtgaacaataaaaagccgttcctcccggcatatagacagtgttttggggagtgactactttgtctaatgtgatgtgaccgatgcagcaaagttgatgtttattcatgtctaaccaattaaaaagcctccaagatagtatcttgaaggcttctagtttatttttagtgcggctgatagccgtaaaacattttggctatttcgcacttattatcagttatttacagagccttcattttagtcaatgccaccgaattagccaccgactaagtcacgaactcctttttttatctaaatcaatgaactcttatttgtaatacaaaggtatcgtttttaatcggataaacctaattaaagtgacaaataatgataaatatcgcatttaatttattaacttcacagcgtaaaaaatataaattatgcaaaataaaaggtatcagaattcttatattaaaggcttaaaaagaaatgttatcaataacactatagcaggaatcgttatagcaggaataatattcattatacaactgataggaggctgcgaacaaccggaaataactcatcaaaaaactctcattgacagtctgcaaataaacacgaatgatgaaattaatgactgggacacagacaccaccatctaccatacaaccactaaaccaactaaataaaacatttttcttgctaaataatcaacctataagtttattatctcgttacttttgcgtatctttgtcttactataaaacaaggagatatgacatttgacgacattactggagacagaaaattatgggctgtacactttgaaggcgaggatgataacgaattttataaggtgttcaacaactgggccgacgtggtttggctacgcactttcttcaaggagaatatagatgacttgaacgcctactttaaaataacagatataaaagaagctatcagcgatactattgaagatagtgaacgccttcgatacatcataatggacatctccccggaaaccgatttaagcaagatattccgcccgctggacaacaaccaggcttcggatatgatgctgcaaaaagaaaaggcccggttaaaacgtaaatacggtcactcgtcatggctccggctatacgctatcaaattgattcaaggcaactacatcatcaccggaggcgccatcaagctgacggctacgatgcaggaaagagagcacaccaggcaggaacttgtgaaaatagacagggttcgacgctacctgcttgaagaaggaatcattgacgacgaagggtttatagagtatattagtgaattataatttgggaggaatgatatggaaaatcgtatgaaatctatcgcacaaaggcttgaagaacatgcttctccaacgccttcgaaatggcgtgagctgtttgacttccttgaaacaaacaagtcttggctccgacattcgcaaaatattgccatgctgatgctggacaggatggaagaattaggaatgagccaaaagcaattggctgaaaaaatgaattgcagcccgcaatacatctcaaaggtgttgagaggacgggagaacctttcactcgaaactttgaccaagattgaaaacgcactggaaatctcgattatcaaagaggaaccgatggctgtataactcacatcggctgcagtaggaaagatttgctatcagatttttccggatcagctgctgcagctcgggaatagtgctagcaaatgtttcgtcctggaagaagccggctgccggattctgctagcagttggcaggggataacaggttgatgaagccgggatcctgccaggtatgtgctagcaaactggaaaaaagtcatgcttgaaacttttcgtctgattgctcaccgtgccgccgtgtggttcgtggcaatgcgtgcagcgggaataccgccgcccacacagccccgctccccacagcagcactccgtcagtgtttaatcggaacattccttcaccggcagcgtttctcggacgttcagtgtttctgtgcaccgtgccgctttccttgctttcccgtagccgtcggactggcgcaaagaaagccgccctacggcagtgtttctatgggagattcttggggaaagtttctttaaagttactccggtgtataatagtcgaggcttgccaagtgggtgattacagaagttactaccgcctgatgcattcagctccggctcccgcccacaccccggcacagccggaccacaggcgacagcctatgcggtggacacccttgcggacgatagcagaagttactcccgtcttatatacggctccggttgccgctccctcacttgccgaatacagcaaaggaagcagcaccctatgcgatggggaccctttcggatgatatccttagcggaatgtaagcccttgcggcacgggtgatagctgcgatgcccggtgcggtttcgctccgcccggcactaacgccgggactaaagcgagaatccgctacctcttttcgtctgactataggaacgggctgttagtcaggagtgcagccatgcggtgcgaggttcccgtgttttatgattgagcgggtttgtctgtttggataggaggcggcgcaagcttccgccgccatgctgacgtgatgctgcttgcgccgtgttcttccggtttttctgatggagtgcagcttttgcgcaggaaatccggaagagcaattatgtttaattagtcacaaaaccgttccggattttgtgctttaattcaacataacagcatcttccaaatattcctgctgtttgcgggcttttccgttgtttcaggaacgggcataaagttactccgtttaatgttcacccttgcggactgcgccctgcgaaatgtaaacgccaccactgtggcggcaagccgccaccccgaccaccaccccttagttacccctgcctatcccggttccctgcagggtttccgacatcttgcgggtttcctgttcctgcgggctgcgcctggcggcgtgcccggctgactgtttgccccctgcggacagtctttgcagaatatcggagattcccggcggtcggcttcgccgtccgcttcacgaagcggggcagacgccccgccgaaaagttacggacaaaagaaattcgtgacaattgcccgaatatcacaaatttcctctgccaacaaacatatataactatatctaccaagtatacaggtaacaaccagccactaaaaagcctatctttacatctgtaaaccaacactataattatgtataccaacgtgcaccaacaaaacaactgccaaagtttaaccaaccgtagctacggtttcaaagaactggccgttctctatttcccgaatatagcacctgcatccgcttctatccgcctcaaacagtggataaaggacgattccgaactactcgaagcattgcaggaaacaaactaccagttaagtaaccgtatcctcacccccaaacaaaaggaactgataaccatctctttcggctcacccttttaagccctagtgcagcagctcctacggctacagcccgaaccctcttcgctaggggaacgccctgcggcaagggggaagagcacttcccccgacaagcgtctcccccaaagggggacggaaggggggtagaacaagaatacacaactaaaaatcatccacataatcacccacaaaaaacaatgattaaacaaagaaacatcaccctgattgtggtgcactgcaccgcatcccgttgtacaagcaacctcaccccggaagccctcgactccatgcacaaacgtcaaggttttgccgaatgtggctatcactattacatcaccaaagacggaacgatacatcacatgcgcgacatcacccatgtcggcgcccacgccaaaggctacaacaccccgtcgataggagttgcctacgaaggaggcctggacgcttccggacgtgccgccgacacccgcaccgacgcacaaaaacaaagccttgaaacccttctccgcttcctgctgctcacctatccgggagcaaagatttgcggtcaccgcgacctctcgcccgacctcaaccacaacggtaccatagaaccctgcgagtacatcaaacaatgcccctgcttctgtgtctccatcgaatacgggtatttagcggttaacggtgagtgatgaacacgtagatatacgcacgaaagcgcagccactaatcggtaaccattaaccgttcatcgctctcttctacctttgcgggaaacaattaaaaaggaggtcattatgaaaccattttggagaacgacgttgaaggtattgaaagttatcggtaaaatttttgtttggctcaccggggcagacagtcccgtgaaagacgatgaaaggagaaacgattaaggagtaaactttacgatcggagtgaaaacccctgtttggagggctgcggaatacaaaccgcagcccttttttcatgtacataatcgtatgatgaaacacgtatcatcacagataagaacatacgtccgcacgcccacgcacgtatatgtaaatttgcaacattattaatcattaaaacactaattaacatggcaattacaatcaaacccgctttgcgcaagaatccgcaggacaaagccgctgcagcaaaatactatgcgcaggtagtgctcgctccggaaatgaaacaaaaacaaatcgttgaccagatcgcagaccgttgtacactgaccggttctgacatcaaggcagttcttgacgcattgatggtcgttatcaagcgcaacctcgcaaacggttcacccgtccgcctgggagaccttgggtctttccgtccttccgtttccggtaaaggtctcgaggatgccagcaagtgcggcgcaaacagcgtcaagaaagcacgtgtcatctacgttccttctacggaaatcaaagaagccgttgcaatgtattctttctcaaaagcaggagcaagcgcagcgaatgaagaaggcggagacgagaaaccagacccgaaacctgacgaaggcggcggagaagctccggacccggcagcttaattatcatcgttccgcatatcgcaaacctgtcaaagaaaaagcccgatgaatgagaaatcatttcaccgggcttttcatttgcgggtatttggtgaacggaatatgcttctgaaagtctcatagaaaacatcaggagtttttcaaaaaacgtctgacgaaataaaaaaaacgtctgatgaatttttgagaacatctcgaagggtttcaagtacgtttttacttccgttccgactgtttttgggcgtttttacgttttattcccgtatgattccatctgtaaataaacgtagtgacacagacagaaacgcaattatctataaagtgacgggaagggatagatgataagtttgctgttttacagcgtatttttcctcttttcttctacaaagataggccacggccgcccgtcagtcaagaaccgctacgctatttcagataaaaatatcctgcgctcctacgtcgtgcggtatttttatctgaaatttcttgtctgccgttcatccatgccctcggggatgtataagaaaaaaggaaaaaaatgtgttcctgtgcagtgtggggcggataaaagcgtgtattagtcttaggcccaatatccgccgaagtgattgtgtctggctactttgtctaacttcaattgcttgcggcgaaacttgttgattgcccgtttgagcgatttacgtcccgatgtgctgcagttcttttttttcattcggcattggtagcaacggcagataccaatacctgtatgtgattctttcatttctatgctgtttaatataagttttgagaacttacgttttttactattttattttgtgacatttgcccgattgtcacggatttgttatttgcacttttcggcggggcgcttcgccccgcttcatggagcggacggcgaagccgaccgccgggaatttccaatgttccgaaaggcgtaaacagtcagccgggcacgccgccaggcgcaacccgcaggaagcacaaacacccgcaacaggtcagaaaaccgcacggctcgggactggcagaagtaactaaggggcggtggtcggggtggcggcttgccgccatagtggtggcgtttccactccgcatggcttttttcgcccgggggcggaaaaataaaacaatccatattaaacataaccacgcattatgcacccgacttgcctgaatggcaaggcgtgcgggcataatgacccgttatgtttaatatcgctacccctttgtttttctgccggtctctttttgggtgtcccccaaaaaggaaggcggaaggaaaacaattgctgtcacggcgcacacagcatcacgtctgcacgcgcccgaaggacggcgaagggtgcttacttccacaatacaaacccactcaaccgtaaacccgggaaccccgcaccgcagggctgcactcctggctaacacttccgttcctatagtcagtcgaaaagaggtagcggattctcgccttagtcccggcgttagtgccgggcggagcgaaaccgcaccgggcatcacagctgtcacccgttccgcaggggatacccttccgcaagggtttccaccgcataggctgtcgcctgtagtccggctataccggggtgtgagcggaagccggagccgtatgcgtcaggcggtagtaacttccgtaatcacccacttggcaagcctcgactgttacacacaggagtaacttttgggaagacttcccccaagaacgttccatagaaacactgtcaaagggcggctttctttgcgccagtccgacggctacgggaaagcaaggaaagcggcatggtgcacagaaacactgtccatccgagaaacgctgccggtgaaggaatgttccgattaaacactgacggagtgctgctgcgggggacggggctgtgtgggtggcggtattcccgctgcacgcattgccacgaaccacacagcggcacggtgagtagtcagacgataagtcgctcgcgaaagtaatccgcttggttcggcacttgcctattaccttcacttgctatcacatacctgtcgggatcccggctccatcaacttgatatccccgttaattgctagcaaattagttgctccggaacgaaccgggaacaagaatccgctagcagaatccggcagccggattcttccaggatgaaactgttgctagcattattcccgatctgtagcacacgatccggaagaatccgctagcacttttacgcagctcgagcacacgatccggaaacatctgctagcaaatatttcattggccaagatcttccggagcgtattttgctagcaatcgtttcccctactctttctccctgcccgctttctccaacctgttgagtgccgacagaaaaccccgcacggcttcgccctgctcctgataccttcgtttcagttctccgtgttccttcgcttcctgcttgtagtgggtacagaaacgggggtactcccgcacaacgtgtttgattgcttcgctggccgttcgctttcctgtaagattcttcaaaatttcaagctgtgtgacttcctcggcagtcaaccgtagcgtgatggtgcttactttttcgctcatgatcgttcaccccctttctcgccatcggaggcggacggttccagcgaaccggtggtttctccgacttgtgttccggcgcgccccgcttccgcttccacctgttgtttccggttcatcacttccgcccgccggtatgcttccgcatacgtctggcagtgtattccgtatctctcgatagtgatgcctgcggctgtcacttcgtgcgccacgcaccaccctgtacgcattttgcgggggtagtagagcggcgtgtcggttgcttttttgttttcgctcatcgttgttgctttttgtgaggctatgaagccgatttgttttttatttcgtcatctccgtgactgctgtccgctatcacccccacggtatcccgtagccgcttcaacaggaacaaccggggcatccgcaggcgtttgtttccatgcatttcgcctagaatttgccatacgggatttcctatttcgccgtgtccggacagtttgagcacctcctcaagttcccggggggaaagattgtaagggcttagggcctctatcaaccctttgggattgcgtggcttttgttcgcgcgccgccgcctccacttgtggcgggcgtttcccggtagttgtggaagcagtattgccacctgttgcaatggtcgtttcaggcttgtttctccccaacggagtggaagaaagcaaagctctcgcttcctcctccgtgagttctccgatagtcggtagggggatagaggaggacttttctttgttttctttttctttgcttttcttttctttgtcgattttttccggaaggtttccagaagtttccggaaagttctggaaatcttccggaactttctcgaaagtaggttctaccgttgtcggtgacaccgacacgtccggtacattttgcccggtcggttctgcggctgtcgcagcttcaaacagaggcatagtgacgggttcctttatgggctgctccggttctacgagaagaatatccagcgggatatacattttcttcttcgccagcttgcagatgtctatatatcggctctgaatggcccgggaggtgagaatacatttcatcttccacacgacggggtcgaacaggcagatttcagcgcaatagtctacaatctctttcacccgttcctcgttcatgccccaatagtcggcacagtcgaaaagctgatcttctgtccagcggatatacgaaccgtcgacacggtagatttcgttcaatgcatattggtatacggcatagccgtcgcacccgtatttctttttcaggcgttttattttgatgtcctgaaagcggtctgtttccgctttgtaataggaaaatccgttcttgctcatattcttctgctgtaattagatgccaggtaattcatgatttcttctttgctgtataggaaagtcccacccagtttatagaacgggatagctcgctccgcgcgcaggtttctcaatgtcgagttgctgatgttgagcagcttgcatacatcggccgatcggatgaatacagcatcttcgggcacggtgtcaagcataacgggcgtaacgggcttgtatttcgatttttcagggtctttttcctgttgtggagttccggctgtatctgtcttttcaggtttcacgattctcatgctgttggtttctgttttcataattctgctttttatatggttaatattcattcaagtgattaatgttcattcaggtattcaaaagtaatccggtcgaggtccttcagttggttactgtcgagagcgtagatcgtctttataatccaccctttcaggacaattttccggtgtccttccctgctgccataataccgcaacgcatcactaaccgccttcttcatttctgaataggtgatgaagcttttctcatacgctatcatgctgtcgatagctttcagttccagttcttcctgattgataattacggttgctttcattcgtttgcggctttattattgggtgatttatcttctttatgtgaatacatatctttgagtgttgccatatcgcgcattaccttcgtatcgactactcgtgcatatacctgtgtcgttgtgattttggtatgtcccagcatttttgatacggtttcgagtgggatttcatgttgcagggtgattgtcgttgcgaacgtgtggcgggcaacgtgatacgtaactctgtcttctactccggcgagtttggctacttttttgagataacggttcatgatctgattgctgacatatgggaatagcggctggttctttttgccgcctttgtggtaggtgtcatatctattgataatttccaatgcaggttctagtaatggcaatgatacacggacacctgttttgacccgtttgtaatgcagccacaggcttttgtctatgccgataacgatgttcttttgcgttaatcgtgtcatatcttcgtatgagactccggtatacacggcaaaaatgaacaagtctctgacaatgcccagattaggaggtagtattacagtggaaagtcgttttacggcttcttcgtccagttcgttgatgtcggttttttctttatgtgctttgagtgcttttaccggatttcgatttatccattcgttattgaaagccatttccatgacttttttgaagcgttccatgtgcttcaatgctccgttaatatcgcatcgtttcatgttgtcctgtcgcaaataaccttgcagataggcgaaaaactcattgacaaaagctgcgtcgatgatacttatatcgtagtcggccactttgtgtttgattcgcacgtagcttagtagatatttcaaggtaactccgtattggtagcatgttgactgggagagttttttcccttccataatcatgtgatattcgaacagcgttttaatggtagaatattcgttatcctctgattggaacatgagtttaaagttctcgatgttgaggggatagttcttttgccggagcttgttacaggtttcttcaatttgcagttttaaatcttcgatatacctgtttgtttccttgtctacagctgtttttccgagtgacttttgggcgactgccgaccatgaagcgggggagatatgacaattcgtcggaatttcgtatctttgccccatgattgtaactctgcagaacagaggtgacagactttcatttgttcgacttttccgtagccaaaacagaacgttgaaagttttttttctttccatacttgattttttttggtgaatcctactttgaatccaaaaaatcaagataaaaaaaggaatcctgtcaccgagaatggcaccgaattgttgttagcatttttcggatgaccagcgaagaggacacaaaaaagcccctaaaatgtccgttttaggggctttttaactgtaaatacagtgtagtttgtgcggctgataggactcgaacctacacgtctcacgacaccagatcctaagtctggcgcggctaccaattacgccacagccgcatgcgtagcttttttgtttagcggtgcaaagataggaagattttctgatttggcaaataattcggcaataaagttattcacttaagatttcgagtgctttttcaatcagtggatctttcttttgtgattctatgtcaccctgctctatcccttcttccagaatcttatccatatttacatatacatcaggttttattccatcctccaatgactttccatacttatcaaagtgggggctggctgagaagcggacgctccaaccattgggtaattctgatgaaaatggtagtcctgatccaccaccagtctggtcacccagctggatgattcttttatcttcgttatcattgtttaagctgcgcattatgttaacaaaatcatttgtggcactataacatcgacgattggttagtatcacgacctttttttgccaacgaatactgttggagggttctaaataaatgggttccatctctgagaaatcattgtgtcccggacctgtcttatgttggatatatcctgttagtgccagtttatcagtgaaccgggcagctatgcgtgaagaattggtcagattacctcctccgttatcacggacatcgataattaatccattgcagatttgtaaatagtaaaggacctcatccaaattgccatctccaactccggcactgaaactttcataacgtatgtatcctatgttattgtcgaatattttatatttaagaccggcggatgtgcggtagcctgaattggcactacccagataatagttataaagaatatcttctctataattccaggggtagccctgataccatgcatcgtaataagaaatacgactggcagaagatagattgacatgcccgtctttcaagatataaagcatttggcttaggatgtcgaacaggtcatcattggacatcgacggaataatcagtttgctatattcgtcatgaacagcatcccagtcaatacctttcgtatccaggaaacaatactgttcgtcaatgatcttccatagttgttcgaaattacctctgggatcattggcgtagtcatcttccccaatgcaaccagtcagcaccggaaggcagcagagcagccaaagtatttgtctaatcttatttctcatcattaattgatctctcacttgaagtttcaacattaaattttgttctcttagtaagctctaaccgatgaaggaagagcagttcctttcttatttcggatacggtataggtctttcacaaatcctaccatgaatacgtgggagtaggtatgtgtcttgatattgttaacgttggattgctgcaaatcagccaggtagctgaagcgcattttggtatatcctatcggcaggtcgacggagagcatctgtcgcaacgaaggttgattgtgcagggaggtaaattttattactccactcgaatttcccaaagagaatatctcgtaataagattgtccgtagtggggagagaacatcactcccataaccggcagattgacctgataacgaagcaccatcggataccgtttgattttcaggtgccaaatagccattccggaggcatccagattgacgtatgctcgtgcggatgccggattgttggtgttccggagattatagacaaagcctccgttgacatctatcaatcctccggctaataatttgaaattatctgtcaggcggaactggtaatgtaatccatagttccagttgactaatccggagaaagtgttattgttatcggcccggttgtgcgtatagctgatgtttgcctgaaagaagttctgcacagatacatttccatcaaacaacttggtcatccgaatcaattcacgggaaacacggaagtcgattcctttgtattcctgtggtgaaagataggtgtcgaaaacgttagtaagtccgacgccatacatggtggcacgtgttacataccgatgggcttgcagactgtcggtctgcgcttgtaatcttgtgctaagggcgaacaggatgcaacctgtcagccccaggtatattagttttttcttcatcagaataatttcatctgcccggtgatttcatcaataatgtcgccttcgctcttgccgctgtccgggtccagattttccggctcctcttcaggaacttcctgttgttcttgtgagggttcggggaagcgagttggttcaagctcattgatcgtctccactgcataggtagtgatacgttttcccttggctttgaaacctttgacagcaatgaattcatccgcatcgatattcaacggatcacggaaattgtcgtgtccgccaaatatgacttccagacgaggatagtactcgtcggtcagcaggatcagacggttgttcttattttctcccaagtagttctgtttacggttggaggcctcaaaacagaaacgtttcagatacggataattctgttggtcggcatcgtaaagcgcggcagtccatatcttgttaggatcaaatttctccacgatgcttacattatcttcatagtggttgctcaagtcgaagttggtagtatagaaatcaccgttgttcagaacaatcaatatgctgtcgtcgctttggaattcacccagatattcacctcgtccgtcatagttgaggcggagtatgtcacggtcaaaccatactttacgtccaccgagcgtagaacctcctttttgtttcaaggatatcttatgtaccggcaagcgggtaagaatcacacctcgtgcctgacgtcccttgatgctgacctcactgaaatcatgctcgaagatgatacggcgtacacgcggattcggtttcaatgtcaccttgatgatttcggcttctccgttcggattagcactgaaataggtaatccgtgattcgggagttcccagtgtgacatcatattcgcggtcgcgaactacagaggtaacggcgaaacgttttacgtatgtcgttccttcttttccatcgcggtaagctatattgtagatcgtacgtttatcgttcttcttgaatacattgacatagagaacgtttttgccgacgaatttcttgtcggcaacaggagtaacgatatacttaccgtcgcggaagaagataatgacatcatcgatatccgaacaacatgcaacgaactcgtcttttttcaaggctgttccgataaatccttcttcgcggttgatataaagtttctcgtttgcttctactactttggcagcttcgatggtgtcgaagttacgcagttctgtacggcgcgggaagttcttgccgtatttgtttttcaacatctgataccagttgacggtataatctacgatgtgagccagatgattatcaatctcggccacttcttctttcatcctggcaatcagttcatccgctttgtccgaattgaatttcagaatacgtcccattttgatttccatcagtttgagaatatcctctttggtgacttcacggataaatttcggataataaggcgtcaggcgttcgtcaatatgagcacaagctgcgtccatatctttggattgttcgaactctttgtccttgtagatgcgttcttcgataaatatcttttcgagcgaagcaaagtgcaacgcttccagtatttcgtttttcttgatttccagttcctgctttagcaaatccagcgtgttgtctgccgactttctcaagactttgctgacagtgaggaaatgaggtttgctgtcgtcaatcacgcagcagttgggtgagatacttacttcgcaatcggtgaatgcgtacaatgcatcgattgttttgtccgatgatgtacctggtgccagatgcactaatatttctacgttggcagctgtgttgtcatctaccttgcgaattttgatttttcctttatcaactgctttcaggatagagtcgatcactgttgaagtggttttcccataagggatctctgtaattgcaagcgttttgttatcaatcttgttgatcttggcacgtactttcactgctccgccacgttctccgtcgttgtatttggctacatcgatcgatccgcctgtctggaaatcgggatacagttggaattcttccccatgcagatagctgatggaagcatcgcaaagttcgttgaagttatgcggcaatatcttggaagaaagtccaacggcgataccttccactccctgcgccagtaataacgggaatttcacaggaagagtgactggttctttatttcgtccgtcgtatgacaatttccattcggtagttttgggattgaagacaacatccagcgcaaacttggataaacgtgcctcgatataacggggagcagccgcaccgtctccggtgagaatattaccccagttaccctgacagtcaatcaacaggtctttctgtcccaactgtactagggcatccccgatagaagcatccccatgcgggtggaactgcatggtgtgtcccacaatatttgccactttgttataccgcccgtcatccagacgtttcatagaatgcaggatacgacgttgcacaggctttaaaccgtcattgatgtgaggtacggcacgttccagaataacgtatgaagcatagtccagaaaccaattctggtacatgcctgttaactgatgttttacgctttcgtcccgcgcgtccgctggtttgtagtctgaatgttcttccgttatctcgttgatttcgtcactcatatatcaatcttcgctttgctttaacaacaaattatcttcctgaacatcaaaaaaggggatgtccacgcaaaaatacgaaataaattcatatgaggacgaaaagaactcacgttttttatgatactgacagttctgttaatcctttgatctcacattccacaccaataaagcgaaaaaaacggaaagtaatgctgctccgatccaaaaaatattgatgtaagaaaaatcatagatttctttaccatcaacgatgcttttgtgcccttcaatgagaactccgctcattatatcttgtatacctgctccgatgtaactggcaatgcctacaatacctaacgctgcaccagaagcgttccggggagcaatgtcgacagccattaatccacccaaaaaacagagaagtactccgatagcggttccgaatagtaccatggataatgcgtctatccagaagtggacgcccgggactagtagaaacaggcatagtgctgctacattcatcaaaccgaagataagcgcaggagcatttctacgtccattgaaaaacttgtcggagattaccccggaaaacatcgtaccaataattccacaaaccgaactgatggagatgataaaactggcatctaacgtagaataccctttctgggcttccagataaaagactccccaactgttcactgcatatcggctgacatacatcaacgcacttgcgatggcaagtatccaaattgccggcatcattaacgcctgtttttgtgccttgttgaagtcagctttatcatcggtttcatcttttatttgtggatgattaactgctgacagtccttcactttcgggagagtcgtggaaaaagttccagacaattaaaactccgattattccaatactaccggctcctatgaaaccatatctccaccctaaaacgctcacaatggaagcgacaatgatgaaagtcatagcctctccgatattgtgacttgccgaccaaaaaccgtagaacgaccctcgtttcttgtcctcaaaccaacgggatagtccgactacacaggaagctgctcccattgactgaaaccagccgctgattccccatagtacggcaaatagaataaaagaatgagtgaaccctaaacataagttagccaaagcggtaatcagtaatccggtggacatgaagcgtctgatattactgcggtctgctagaaatccattggtgaattttccgatggcatatgtgaaaaacagcacggcaccaatgataccgagttcggtttctgaaaatataccttcttcgacaatcggcttttttactacattcagactaagtcggcaaacgtaataaataccgtatccggcagttgcggaaaaaaaggttgcccattgtagctttttgagcttcttcttgttctctttaagaactggtgcaggagtactgatttgatagaatttgataagttgttttaacatggtaattagtgtttgttgctttaaaaaaaagcaatagtgatagtaaggtgtatcggggattaccgatacaccttactgataaaaatataaattgtggattaattagtaacttaagccgtcttcccaacccggattttgggtcagaatgccttgtgtcaatacgcgttgatcggcaggaattggccataaatagtctctttcctctttccagtcattgccataagtaactttaggaaatccgataatatagccggatgtaccattggagaggtaaatatccttatccagtttctttttattatcacattgcgaagtagctgtggtttcgtagatttccaaatcaggttttccgtctccatccatgtcatacgttcctactccaggaatatagatgccgtagtaaggaatgtactgattgaacatttgttttccttctttccatcggaacaaatcccattgtctcaagccttccataactaattcaatggtacgttcgcgacgtatttcgagaatgactcctttgttcgctccctgctcaacgttcggatagcaggtacccaaatacggatcaggattgttgttggcgtctgtaagaatcaaatccggcatttttgcccgttcacgaattttattgatagagatatccagatcttcttgtttaagagttcctaattctgctttagcctcggcataattcaggtacacttctgcggctcgcatcagtggccagtcggaggtacttttggcggctccgtcatggtctttcgttcctacgaatttgataggtctgtatccgcagtaggcagttaaatcattagcagtaacggtggtttctcctttctggatatagttcgggcaaagtacagtttgttgtaagcgtggatcacggtcttttacctcttccgtatagaacatagtttcatatccttgtttatctgtgaaacgcgttccgtcagtcatcaggtagtgattcataaaccggcgggtgaagcccatctgcagattggcgatgctgaattgtacggaatgtgataattgtagaccttcgaagttataagctcttgccagtacaacttctgttgttttggcattgtccgcacagaacatatctctgtaaggttctgttccttctttatacagactgaagccgctttcatcaataaactgcttggcagtgcttgctgcaatttccagatatttctcataattgtccagtccgtggtatttccgataagttccttcatagagtgcagcttgactggcaaatgccagtgctgcccatttagtgactcttgtattccgagtgtctgtgcttttagttggtaagctggtggcggcatcttcgaaatctttgaggacccgatccatcacaaattcgcgtgaatctctggctttagccagtaattcctgatcttccgaacctaatacctgatcataccagggcacgtctccataacgacgtacctttacgaaatagaaataagctctgaagaactgtgccacaccgttatattggctgcgggcggtttcatcatcacaattggaggaatgttgcagaaaataattgatgtgacggagtttgctccatgaccatccggtttcgctagcagccgaacgggtaccttcaatcacctgtcccatgcctttgtcaatcatatcgtctgcatttgtaccggctgaagcgtccggttcatccagcaaagtataaaattgattggtccataactccaggtcggatttattttgaaagtaattctccggtgtcactgcattttccggtaggagtgtcaggtcgcaactactgaacagggttgtcaccattcccaggataattattttgttgatagctttcatactatatctgattaatcattaattaaaaagtaatatctactccaacagtataaacacgtggataagcatatcccgaacctgtgttggatgagtaagtgctactagagatagccaattccggatcaatggttttattatgcttcttcagaggcgaccaataatatagattctctcctgaaacataaacacggactttttcgaaaaaacgcttgttgatgggcagggtatatccgatagagaggttcttgaaacgcagataagcaatgttctgtatatatcggtcattgactgttccgagtgaacctccggagtaggattgataacctctgatgcgtgggaagaaggcatttctgttgtcttctgtccaacagtcttccgggaatgacttttctataaatgaggtagaagggaaagagtaggggccccagaaagaattcgctccttgtgaactggaactggaggacggataccagtctcttttaccgatcccttgaaagaaagcagatacgtcaaaaccattccagcttgcatccaggcggaaagaatagttgtatcttggagtcgtatttccgatgatccgtttgtcgcccgggtcatctacggttcctgctcctgctccgatcacgttgtctccattcaagtcggcaaagcgtacatcaccggcacgtagataaccgtctactttactactgtaaacacgtccgttcacggctttgtcattaatctttgcctgatattccgcagcttctttgtctgttttaaacaatccgtctacatggtatccccagatttctcccattttctttcctacatagtggtcggaaatcagtttgtccgggttgttgtatttggtgattgtgcgctggtaatctcccaaggtagcttgtatcccatatcggaaaggcttgttggctactttgaacgaatcgttccatgaaacagataattcccatccgtttgtccgtaagtcagcgcaattggcttttggggtagaagcaccgtatacatccggtaaagtcaatgaggtggtcagcatatccgttgttttacggacgtaatagtcggcactcatacttagacggtttctaaggaatgacatatccaatccgacattgtatgttgtaacagtttcccaggtcagcccggaagagattggattggaaattttcgcatagtatgcttttccttctccatcaaaggtataactgaattggttatcggaagtgattgtttgcagataagcgtaataatctacttgttggttacccagactgccgacagaagcacgtaattttaaactgctccaccagtcacttacaggtttgaagaagttttcttcagaaattctccaccctgctgataccgaggggaatattccccatctgtctccttctgcaaatcgggaagaaccatcagcacggcaggatacctcaagcaagtatttgcccatgtagtcatagttgatacgcccaaagaaaccaagagtcttataggcactgatatcttgtgatacggtaagcacactttcgggtgttactgccgaaaaggagtcgaggttatcattggacaagttggtcatggaagtatctttgttgacattacggtaagtctcatactgactacctgccaccactttaagattatgtttctttgcccatgaatgttcaaaagtagcatagtaattcagcatatgagtgacggggaaagattcgtcttcttcatagttgttaaagatacttccggaagtgaatgtctgtgtcactccctgactacgtgaatattcaaatgagttgttgcgatagcgatacagctgttttctttgctgataactgtaattggcagtcaaagtcaatccttccagtaaagtaatatcaatctggttgactacagacaagagtgttctggatttggtgttatgccctctttgagatgtcagatagccaccgtcgccggctccgagaggggagttggcataaagttggtttgtatattgcacaattgttccgtcaggattgaaaggcacgaatgacggactgatattcgattccagacgagcaatggtcattgcataattggaagttccgttatatctgtaattgttgttgtccaatccgatatttgtcgaccattttatccatttattcagttgggcatccatcttggcacggaatgagtaatctttatagaggtctttatcaatgttgaacataccatactgctgatagtagcgtccactgatataataattcaccttctcgccacctccggtgatggaaatgttatgttccatctgtgggcgggtgcgattgtagaagtgtccataccaatctgtatttccataataatagtacttcccgtcttctccgatttctacccaggggcgttcaggattctcagtcatatcattcctgcggtcgtagagcttctggagttcttcatcttcatacaaatacatattcacaccattgtatgcatggtagaacttgttggcgaaagttacataatcatacccggtacggataaaatcagtggaagtcgtattctgtgtccatccgaaacgaccgttataggaaattttggcttttccttttgttgcggcacttcccgatttagtggtaataagtaccacaccagccgatgcttttgctccataaatggcacacgaagatgcatctttcaatacagaaatcgattcgatatcatttgcattgacttgatttagcggtacttctacgccatcacacaatactaacggcgtgccaccgttgacagagatacctccacgaatgtttaatgaataccctgactcgggcgaacctgtaccaaaagtaagatttacagatggatcggctccctgcaatgcattggcagcagacactaccgggcggttgttcaggtctttactagagatggtggaaacggcacctgtcaggttacttctgcgttgactaccgtagcctactacgactacctcgtcaatcatcaggctggaaggaatcaggcggatggtcttggtctgattgtcttttacattgactgttgccatttcataacctacgtacgaaatttcgattgttgagggtatgaaagcttctaaagaaaactttccatccagatcggtaattgctccttgtgcggtttctttgttcatcactgaagcgcctataacaggattaccttcttcgtcataaacaataccggtaatcgtctgtttctttttctcaccgggcttttgctgactggtatctgactttttactgataatgatactatgcccgttgatggcgtagctaacattctgtcccacaaaaatctgatccaaaacggccttaataggcgcattagtggcattgactgacacttttttactcatgttgatctctgcggatttgatcacaacagaataatttttggtcttatgtaaagcttctattgcttcttttacagtaacattctttaattgtaaggttatgtcttgtgctagaatgggttgagagaaaaatatcatcacacaagcaaaccagatcgttgatatatattttttataaatattagtttgcttcatatcaggttatactactgctaattttatggagctgcagaagtaatcaagattactccctgactccgggttatggacatttgtccgtctgtattgagattggataaaatctcatcgagagtttccccgttagtgaagtaagcaatgtaagtgctgtcacctagcttttgatctaatatgatgattctggtatcgaaataatattccagttccttcacaatatcattaaggggaagattactgaaatagaatccttcgtttttggccggacacttgtacagattggcaaggaatgtatcgcggacaatcttctgtgaagttcggttatactgaatcatttctcctttcttcaaaatctcattaggatgagttggagttttgaacagtaccgaaccttctacgagcgcgacttctactgtctcgatattctcgtaggcacggagattgaactttgtacccagcacctgcacatggacgtcaccagcagaaatgataaaaggcttgtccggatcctttgccacatcggcaaagagttctccactgacaaagatttctcttttattttctgtgaaatcggaagggtaaattactcgcgtgcctgaattgacatggagcgtcgttccatccgaaagagtgagtgtctgatgcataccgtgtggtacggtgatatcattccagtgtgtatttgccttcttgtcaagaagtaaatatccggctaaaaataagagtggtataaaaaggacggctgccacacgctgcatccagcggattgaacgctgaagtcccgggcgtggtgtgcggacctgttggggttgagttgctttttgaaatttctcaaaagctttttgagataactcatgattctccatttgaatttcagagataatctcacggaaactctggtccactaggctattgtcattttctgtcaaccacttttggatttctatttcttcctcgtgagaacacttatcatagaaataatcttttaatatgtcattagttatcttcatagcgtatttgtttaaagtacaaaaatgcattttttttctttatcaatgagtatattatgttgattatttctgaataagatattctatttgggatagatttgtatttttaatctgatctcatattcataagcacttgtttttatttagtatttcgattatttttttctctaaattcttagcccaaaagtagtagccgaggtcagacggatgggttccgtcggtacaggtatccctgttttcgggagatggcaacggattgcctatcaggtagatattcggatatttccggatgatctctttcataagagtttctactatttccagtttgtcactctccctggctcgaatcaaggtgttaaatgcttcattgccccgttgaatagtttgtacgaatatcagaggagtcttagggtgtttggctacaatgatatctacaaatgcttgtaaacgttccttgatttgcattgcgtcggggttggaaaacacatcaaatacaaaagcatcggcttcggtggctgctatcacttccgcaaaataagactgaagtttggcattgccactgaatcctaaattgcagacatgtaagtttgtattacgctctatttgcagcggataactcatccccggacgacttgctccaataccttgcgtaaaactggaaccgaagaatacgactttttgcccaaaaggattcgggatcgtttcgattgaagatcccggctgaatgcctatcttcagagattcgagttcgctgtacatcggcaggtaaagcagacattctttttcctttggctccataccatacatcagtgtgaatgcttcgttccgtttagcaggagctagcgaattggcatatatccattcattattctgtctgatatagaggtcgaagccggcagctgctattcctgttacattatctttcctgtattcccatttatacgagggaagcaggtcaatctggggtgagttggtcctgaaaacaaccgctaatcctgctgaacatctggcttgctggttttctgattttgaaaatcccttgaaagctaccgtatctatacggtgatatagatgtggggtaggcaaggcttttcctacaagggtcagttgggaggcatctacatagcggatgtcttttatactttgtccccataggatagtcggtgccaaaagcgaagccaaaaggagcaatctgaaatttctcatgttttcttatctggtaaatagaataattactttcggggattaattgtgccgtccgattttcttcaggtagctgattaataactccggtcggtcggtttgtatgatggatgtgccgagatctaataccttttggtaaacttctgccccatgttcaaaagcatagtcatcgtacatacctgcttcttcacctccgcagagtgaggcccaaagagtatttacccagattttagaaccttgtgcaagtatatccttcatgcatttttttacttccgaagtttcttgctgccagcatacttcatatgctagaggaatgattttcttgtccatatattgacggaacaaatcttgtccgcttggtttgttgatatcaataatgggcatgtacatcatggcgtgtttatacttcttagcttgtgcatctacaaaatcaaccgactttttacctttaatcaagatttgttctgtgactcccaattcttctgtgatagccattaccaaatcataatattggtacccttggtctatgttaaccactatacggtctttgcagacggccaatgcttcttttaaggtcggcatcttgtatttagtggggcagttatgacctgttttcaggaaacagcttttgatatagtcgtaagttacgtcgctgactctgccttttcctgtggtagtccggtcgatagtaccgtcgtgacaaaggacaagtacactgtctgctgttagtttcaggtctagttccatgacatcaactcccatgcggataatcgattcgatggcagggatggagttctccggataatcccgccagtctccccggtgggatactaccactacatagtctgttttcggattgtgaatggcttctactatcttttgcgcatgtgtcttgtccggagcgacaggagtgactgcaaaagtgcctagagtcagcaacagaagaagtccggtgaataagattctttttttcatattcatatcattttaaggattaattttttttgaataaaagaggacgaagtacaagatgctgaagatcgtaagctgtgatgatcacatgaccttcatcaaaattgttttcgaatattacagtaagggtatgagtctctttgtcgattgttgcttttacgttcaccgcttgggcaatagtgactaatgcttcttctgcagatgctcccgttacttcatattcaatttttaggggactggaaagatcggttatttttgtaacagcatttgcttttaacctgagattcagagaactgaacacttccagtgtgagtgtttccccattacccaatgtgattttgagatatccctcatcagtcttggtaatatttttaaaaatggccgtctcgtcggttgtagctgtaataggagtccccttgttatccttgagtatctcaccattgactgtccagtaaccgtcggcatttacccccatttcgggggtatagccacagacgggtacttttttttcggtatcatctgtgagccagtttgtctcattgccaatagtggtggtccagtaatacaactggtcgtcatcgttgaggcgtacaccgagtataggggcttctattacatcttcctgggttgctacaacaactgctttttcttcattattgttgtctttataggtaataacatattgcccgtccgagtttcgggaaacagaggtaattacatttccttccgtcaaatatcccagttttgagatatcttcattgagtttatccgctttggtttgaagggcggctattcgctctttgaaatcattgagcttattctgaatcgaagagtcatcataatccccacaactggtgagcaggagggaaaaaagcaccgaacagacaaaatatattcttttcatatcttgtgtcttttagaaattaatactaggatcgaaattttggtttgcatgacaaaatgcattctggttagtggcatctggtgcagaagtaggatcgtccttatacttgctgtaatcaccgacatagcctccacatacacaagccttgcaattggtccaggttgcagtggaagcaccagaataaccacataaccagcccggaccatgtctgttggtcccatttccttcggtgaatacatctcccaaaacagcacctttgtttacgcaaccgataatctgtatgttagagtgaccgatgatgcctcctgtgcggacacttaggtgagtcatgacatttccgtaattcgtgcaggactctactgtatattccggtttggttttcaggtcgtctgtacctcctacaattccacccatacgtttgtaattgtaggtcacactcgcttctttgccttcatgttgccctactttgtcatcttcaatggttcctctgttgtcacagttgtaaatgttaccatacattagtgttgctacaattccgcccgttcttccgctcggacaactgatatcgccatagttggtgcagtaattcaattttcctccttctgctttagccatgaaggcgcagattccggctgtctgcatacctgtaccgccattagctgtattgctgatgcgtcctgtacggacaaatcctctgttggaacaaccttgtgctttggattctcctccaatggttgtgttgacaattgtacctaccaggccggaaagtgcgttaaattctccggatttattatcggctgtgaagtcgatattataatagttggtacagccctctattaccgattttttggcgaagcagacaagaggagctatgacagtatatttagatgctgttccgctcatcatccaagttatagtggtactggcatctcctaaaactaaatttttgattgtcgcattttctatcgaaccgaataaaccatacgccaatccaccatttgttatatctgcactacaattcaggttcttgatagcatggccttgtccgttgaaagttccagtaaacggatgtatggaaacatagggttcggccgtagtatagttggaagcttctatatcaccgataggtgtccaactggtcacggatgacatatcaatatcattcaacaatactatctctccggcgtcattctgccagcgggaggtacttgttccgttatttacggcttttgcaaaattaactagatcggcagcagtactgattcctcctttagcttccacttctttagcttcttgtatcacatcgatacttgaagatatattatacagcgaattagagaatattattttcccggaacgttcgtcacccgtttcattagccagaatggtgaaggcatgtgtggttgtaattaatgcacgggttcctttgtaagtgatccactcgttttctgtactgacctgatagaatatgttggcagatatctgcatttctatgtccatttgggtgcctttgagttggataggacctacatgaccttggtatagtggatcgtccagaattgcggtaccgtatgtgaagtatatcggtttcaatacggtattatttcctgcacttgccagcaacagaatatttccttcagtcgctccttctttcatggtagcgatgagggtggaagaggctttatctattttgacttccatattgtaggcagtaaacaagtctacatatgcattttccgattgggtaccatatatttcatatggaatactaaccggagtagcatagtctgttactgcattgtaaaccggactgttgaaccggataccgagtgcctcttgtaaactcatacgcaattcctgaccgtctgccagaataaatacggcttctcctgttttatcatctatataagccgatttgaataacagattacttaaatcattggctaatacaccggtgctggcgccattcacactccaataaccgttctcgtttattttaacgtcaggcatcgttccgcctatcggaaatttctttccgtcaccgtcgagaatgaatgtataagtcttccctttatcagtcgtctgcgcccaatagaatttactgtcagtatcctgtttggccgtgatgataggaagtttgatggcatcttcttgagtagcgatcgtaacggtgtgggtttccccaccaccgtcactgtaagatattacgtggttgccatcggcatcctgactgattaaagtgataaacgaactcccgatcactttagacagtgaagtcatttgcttggtcaatgtttcggcttgagcttcataatctccgatcgtcttttctatttcgttgaggtcctgccagattcgttcgtcgtcgtaagaactgcaacttcccagaaaacaggcagatataaataatgatatacttataaactttttcatatattcagtgattaacattcgtttgattcattattcgagtactctgacatgcagatagttcatacaacttctctcacctttcgtatccgacacgtgattgattacttttccgataccattctcataagtccacattactgtagagcctcccccatcgaaacggattacatcatataatcccaactttttgcaaacacggtaagcttcgtagaaatcaagtcctctgtcactatctgtccttccgtctacacagaaaataacaatctttgatttatcctgtgtcataccgagattggtggtcgggttgattgtctctgcatcttcttttttaggaggtgcagagtatacgccattatatacatagcggtacatactggagttgtgtactttgattggattagtagaactgcctattttaagttcggcactgatttgtactttatcaccggtttttaggttttgaactagttcgtcagctttgtctcctgttacttgcagtacccattcatttttatctgttacgtatggggcttctactgtagtgcctcgtccgtcaatgattttagtaattgtggcttcaaaatcaccagagttaacctttagcggttggttgttcttgccgatgataaatagggctttagttcctatcgggttagttaatccgggatggggctcttttacatacctgaaggtgtacaagtttgcatcgtatgatggttttccactcaaacggacaatagtatcattgactgaataatattcatattccttggtaccaactttcagtttgcctgtgaaatctcttttttcgaagctaaccgtacggttgtcaaagaaggtgaatccccagacatgattagttaagatagaacgtacatacgggttattgatgaataccggttctccttcttcaatatgcattcctctggggaagccgtcatgtgaattgaagaagccggtatttatacctacaataatgtttcttccttcatctcttcgtctggtacaagtctccgataaggtttcgcggaggactttaccattatttgaattattattaccattcgggtttgggcaaatttcgtctgccatgactgtctcgaatgtaactttggggttgttcatgtcaatttcaatagcatagatattttgattgaaattgataaaggagtagtgtttgtacacaatacctgatgctagttcacggtcctcggtcacctgccagtcatagtatgcctcatcctggttagagaaattattggcttctttggagaaagctccgtgacggacagcgttactgtaagttgctcccggagtatcttccggattatttttgtaaatactgtaatctccaactttacctccgatatgacaatctgtgatatagttcgtaccgtttttggtgccactataaccacaggcccatccggcaccatgtttgttggctccatcagcagttgcatcggacaagatgattccattgtttgtacacgattgaacaaatccggcattgtgtccgacaaatccacctgcacgacttccgttttgggaatagacatttccgttgttaatacaatttttgaggtatttatctgtatttatacctcctgcaagtccgccgatgcgtttcacattatatcgtttggaagttgaagcaaaaacaccattcacgtcatcttgaatgactccttcgttagtgctgttttcaataattccttcctgtagagttcctgcaattccaccaccacgcccggaaggtgcactgatatttcctttgttaattgcgtagccgatataagcctcatcattttctatatatcccgcaatacctccttggttgaaagctgaataggcaccggaagcagtgttgactatgttgctgcacgtcaggttaccttcgttgctgcaaccgtttgcttgtgttgtgtcgcctattttatttccgtataatacacctgctaaacctcccattcgaacacctacattagcagcgtctgttccttcaaaagatagatttatttggttggtacatgccagtatgcttccctcacaatagcctactaagccgccaatagcagctccttgcggagctttacctgtaatggtggcattacccgaaatcactaaattcctgatgacaccggaactgccgagtgcattgaataatccatgggcaatattgccgtcttcaagattatatgtaaaagtcagattaataactgaatgtcctttaccatcaaatacatcgttaaaggtttgctcgccgattgtataaaccacttttgtattggcgttggtcgtattgcttgttacattacttcctgcaccgctcgtcaacgtgatatctttcatatcaatatcgttcaacagaataacgtttccttccgtatctttgaatttacgcaaactacttccactggtcacagcatctataaatgctttgaagtctgttgcagtagcaatgcctccgttttcaatgataggcaaagtgaagcgcatcggtttgatcagtacgttatcttcagtgtcataaagcataatcattgttaccccttcttcgaaatcatcagcgaaggtgacgaccaatgttttattactactatttaacctggcttctaatccatcgtcgttgcgtgtgatgagcatcaatgcttgtgctgcctttttcccaatgatattataatttaaggtaaggttttttgttccttcctctataataataggagaaatggcagtctgatctgtatttttaaactccacattaaatagtgtaaaggtattgaccgatagagtttctccgttgcctagagtaattgaagcagttccgttatcgttcatttctactttagtaataagtgaagttgtttttccttcagctttaatcggcttttggttgctgtctagaatttgctggccgttaataatccaatatccattctcatccactcgtatttgaggggcgctacctgataccggtattttttgtttgttggcatccagcaggaaagtcgtttgacctttggtggtagtagtccaataatatgttccggcttcttcttgtattccgataatcggactggaaaccatttggtcagtggtagcaatggtgaaactatgctcaatattgtcacttcctttataagaaatgacataaccaccgttagcagcttctgtgacagaggtgatggctcctcctttcacaatctggctcaacgcattcgcttgcagttgtaaactgtttagcttctctttcagttgatcgagatctttgtagattccatcaatgtccttccaggcagccgagtcatcatagtcatcggtgcaactgccaatcacgggcatgagtagcaggaataaaagtagaaaatttctcatgttctttaaataaattgattcaatggttaatagcgcgctatgtgtgattcgtttctataatgaagaacacatcatctaacgggggtacgtaatcggatttgaacttttttttaaaatcatcactattttcaataagacttgaatttttcatattaatttcatagttttgtcaccagaagtatgctactccctgtttatttctcccttacatattacaatatgatgtgattttaaatacggcttggtatatcttctatattatttatagctttgttgactagaatcttttttagaaaaaacgatgaataaaactgatttatcttctgctactgaagagcaactgttgttacagcggttgagagaaggggacatggggagctatgaaaccttgtttcatcgttattatcctactttttttgcttttgccaaaggtatgctgaaagatgcaggggcagcggaagatattattcagaatgtgtttatgaaaatctggatacaccgtgaggcgctggacgaaacaatgtcaatcaaaaactatatttatgtactctccaaacgtgaagtctttaatcatcttcgggccaaatacaatactcatgtagtgttaacggaagacatgatgacattggagcgaccttcaagtatggatgaaccaactaccgactatcgtgaattgcgagaggcagtacaaagtgtgattaacacgatgccacctaaacgccggagtgtgttttgccttagtcgctttaaatctctgactaatcaggagattgcagataaacttggtatttccattcgtactgtcgagaaacatatagaactggctctccgtacttttaaggaacaattagggagcttctttgctctttttgtagggtggtttctttagatgaagagaaggaagtgtgatgataatgggtggattttatagtagaaagagatatgtcgtatacatgacatatctctgataatttaatgagaagttgatttaaacccgtatttcccaacctttttcgtactctcttccccaaagtttattagcttccaaatcgttaagaattcgtccgcttcccggatcaatctgtaatgaatgtccaacacgttgggcaatgttacctaattgtaccaactgggtactgatacaggcatctacaattccggaatttaactttgttcctttacgaatggcatcaaaccagtttcggaagtggaaggcatccagcttttcggatggattcaacagattgccggtctcaaattttaaatcactttttacctctttaatcgttttaccttttaaatctgcaattttatattcattgccaccgccaatgaagagagttccggtttctccataaaatgcggttcctactccatatccgtctaccggcatcgtattacaactacgtccttcccatgaaaaagatgcttcgtcaccaaattggaaggtgataagttgtgtgtcaggagtttgccagtcgtcctgaaaacgataccgacctccgatagaatcaacctttgtaggataatctacacccaatccccagcggagtatatcaataaagtgagttccattgttgagcgcttcacctgtaccccaattccagaaccaatgccagttataatggatgaaattatctttgaaatcagcaacacgtggggcaggaccttgccataaatcccaatccagataatcaggtacaggaacaactttccctgttccaatggaagggcgattattgacataccaagatttggcatatctcacttttccgatagaaccggattttatttcttccatagctttaattacattgggaaaggaacggcgttggttacccacttgaacaatccggttatatttcaaagcggctcgaaccaacatttcattttctgccggattatgactggtcggtttttccagataaacatgctttccggcctgcatagccataatggctgctttggcatgccaatggtcaggggtagcaatcaccactgcttcaaaatcgttcgactctaacatcttacgaatgtctttttctcctttgggagtacgtccggtaattttgtggatagcagcctgacatttttctaatgctcttgagtctacatcacaaatgtaagtaacttcacaatctggaagtttggcaaatccttgcgccagggccttacctctcgagttcactccaatgactccgatacgtattttttcgttagctcccagaatatcttgattacggcttgaaccgaatcctggaagtatgcttcctaatgagagtgcagctgtacctgctactgtttttttgataaaatctcttcttgttgtcatagtatctatttttctccaaaattaggttgttattagaatatgtgaatgagtatttccgtcaattctccttcaaaaaacgtaaatctcttatttttttcttcggaaaaggtgactcaagaatatcaggattcctcggggaatccataatatgagatagatgaaaaaactaatcacgatgacatacccgatttgggatattatttcaatccatgggcgggaatagataatgattgcaattacattgatgataaatgcaagcaggaaacttagaagaaagatattcctttcttgtttcaacttttttgaggtgataataatatctttcatagtttagaatttcatatagggtattttatattcgtcggggaagaggatatggcgttgttcatccattgcctgatttccaagtaaacaaagaaccgttgaacaatatgcttcttccactacattctgtgctttctctccggtgatacacgactggcagaaagaagacaggataatgtccgaaccgtctttgtctgctccgatcatactcaatccactgtttacgtgaatatctccatcaatgataaagtgtggtgtgtactccatttttgtttccggtcgccaactgggacctgctgtcgggatggcggcaaagaccttgtcttttacctggtcaatcagttgccggatacccgaagttgaatgatcttcttccagataataaataccttttgccatttccatggttcctttacttcccagaatctggtcttccattccgttgaacttgttggaaatcaatgattcgtatgcgatcttaactccatccgagtatctgtaagtgacattgacgctatcataaacttctcgtccgtctttccagtatacaatgtcacccattcccataatggattccggcattttttgggctgcccagttacaaacttccaactgatggcatgctaattccgtcattaatcctccggagctctctttgtataatctccaattaattttgcgttccagctctggtgaaggaaccggacgacgccagtctgcattacggaaccagtgacagcgaagacctactacatctccgatgagaccggaatggatcatctgcattcccttgatgtacttctcgtcatacattcgctgcatacaaaagtagaggactttgtctgactggttgtaagtgtcatagatagccttgcactcgtcaagggtacgtgccattgctttctcgcaaaagacatgtttgccggcagctaatgcgtccaatacaataggtgcatgccagtttagtggtgtggatatgatgactccatcgatgtccttcgattccagtagtttgcggtaatccgtatatggctttgcatccggacaaagttctaatgcttgttgaagattgggggcataattatcacatacggcaacaatttgtgcatgaggtatttctttgaggttatggatgtggtattgtcctctggacccggtaccaatcaaagcgattcgtgctttctcatgcttgatctcttgtagtttctccggagtacaggaagtcagccaaggagtggtcgccaataatgcggttcctccggcaacatatcccaggcttttgatgaattgtctgagtcctaagtctactcctttttctttatgttctttcatatcataaattgtatagggttgcttgtatattattgaacttttctgaaatctttttttgttcctgttcattggcaatcatccagaccgtactaagaatttcggcttccaacgggtcgggggacaggatagaacttgcttttcgttgtttattaaatatgcctgtaagcggattcataatgtgtccggtatattgtaacgtattgccggaagtggataatgctgtatcctgcagatcgaattcttttagaagagactgattgtacgggttcagaaaactgactttccaacaatctccataaggatgatgtcctatacccaggatcgaactgtttccaaaattagcaaatgcatcactaatattctcctgttcaatgaattttcttattttcttcaaagcatatcctttggcaaaacctccaaaatcaagtgaaatatcaggagatgtaaaggagatatatgaatgttcatgaagttgtatttgggagaaatcttttaatgtaatgtcgaataagtgtgaagtggtctcataatagtatgagcaaagctgtaagattgatttcatctctttactgatttgaatcttgctttgagaagcatgattattaatcttggaaacttcactatgaggatcaaaacgatttaatattttatccaatcgctccagctcataggcgatatctgcccaaagtgtattcaatcggtcgatatcggaatgaatgagcaggatatcgaatcgggtccccatgatatgaggaatgaagccatgaaacatggcttcattttcataatatttgcatcttgtttctaacacctattgttttgtttatttgtttcctttctttgccatttctacagcagtagtagtaatgtaatatttagctagtgtattttcattttcccattccggcatatcctgattgtgtacataatgcaggaaagcctttgccactttgctgaaatgttcttcgtgtcctaatcgtttttcctgtggtatgtcaatcagataagttccattctttttgtttttgacagataagaacggataagttatttgaagctgttccactgttttttgcaattgagcttcaaatgtccgattgtcaatgtccggttctttctgtatatatagctcttttacaaatccatttttttcatcctgaacgatttttaaagtggctttacttcctttctttatggaagtaaatgtatctcctccgttagtgggtggagtataattccatgtgactttcattcctatacaaatccctttaacggtatagttgagacttccgtttgccatcacctccaatacatcgttttttatgtatcggttaagataagcgggaaaagaatcgatttgtgtcgattgactgaactctgctaatgtaattggagttggccagtgtttggcggcattcacggtgacatccgattgataatgaatcgtttcatcaggaaaacattgccagttgatgaggtcgatcagatgtgttgtaacatctgcaatgccttctccttgttgctctacatcgtaataccatgccgggcgaattaatggcttgccagaaactgtcttgaaaaaatgatgcacgctttccattatgacagatggattgtccggtgaacctttttgtaaatctccgaataattccgtctgatgcaaaagctctttttctatgatattgaggatatcataacgttccgtcatcagatcgtataaaagaagattcttttctttggcgagttgataggcttctgtcaataacttgaaatcctgtggattgatagccagtggcttatcggcaaggacatgatatccggctttgatagactccatgatatagcgcgtctttttctgattgtttccggccaatactactacattacctttatgatcggcaagcattttctggagataatcatctccggtatatacttgttttttccatgtcgtaggagattccgcccgctgattataagaatcaatgctttccagatattggttgacggctattccttcgggggcatatatccggatggtgtcactgacatctgtcaatgtctctttttgaagtaggctggcatggaaatgtccgggatcgagaaccactacttctattttacatgaatcattggcttccgccttattcataatctgtttcttggagaaagaacatgaagaaactataaataagattgatataagcccgattcctttatatataaatttcattttcttatttattataggttttgattaatttccgggcgtctttccatcctttttggtaagcttcttccaatgtgacaattcttccattctcttctttactcatattggatgctttcatgaaagtgaatatttcaattgtttcttctctggagataggagagattcctgtttgaaagtatttaagaatctgttcaagaagcgctttataaccttggtaacctcctgcggctactgctccttttgaagtataggcagttccaccataaatttgcggtccttttataatcgctctgaaagttccgattctaccatctttccatcgtcctactactacatcccctctatctgaagacatccggttgactgattcgcatcctgttcccataattgtgtataatgtttctactccatgaatgccatagaaaccgaaatccggatgcgttggctccactttgtgaggagaataacaatcggctccaaggattttgccaaattctccatttcttaatttctggttttgaggagtaaatctaagagcagaagaggaaaaaacaggtgcattgtatttttctgccatttcataaatagcgattgcatctcctaaagtagctccgacaggtttgtcaatatagcatatcttacctgatttgaatacctcgacggcttgttccaaatgtagtctgccgtcattggtttccaaaaggacacagtctactttttccagtaaatctgctattgatgaggtgatttccacgccatttgctttgaccttttcaatgtatccggggattcgttcgtaactggattgaatagtctttgaaccgtacggatacgctgctactatcctaaaacctttggaaaaggtctcatccgaaccactattaatcaattcggtgaaagcggtggaatgggatgtgtccagaccaataattccgatccgcataactttttgtgcgtgtatactgaagctgatagccagtagtataagaagtgagattctgtttttcataatcctttataaattaattctttctgcactttccgggtccaaatataacgaagaattttcttttcttcgcaatatgctggccggacatttttctgaaacttcaccataaacagtctgatagactgcttgagctttatttttgaacgggacgatacaaaacatccattcagcttttagcaaagccggtatcgtgagtgttaaagcttctttgggtactaagtctagtgtcttgaagcatttttcattgacttgctgttggcgacatattgggtccagttcaactactttcacaagtttgggatcattaaagtctgctacatccggatcattgaaagcaatatgcccattttctccaattcccaaacaaacgatgtcaaccggatgcttagtcagcaagtctgcatatcgctgacattcctcttcaaggttttccgccagaccattcagatagttgactttcttgaaaggaactttgtcaaagatacgaattctaaggaaatgtccaaaactttgtggggcttccggatgtataccgatgtattcatccatatgaaaagcgtttattctggtccagtcgatgcgtttgtcatgaatcagatgactcaaaaactcattttgtgagggggcagcggcgaaaatcatatttatttccggtttgctttccaataagcgacaaatttggtcgccgacttcttttgcggctacactgcccatctcttgaatggacgggaaaattcgaactgttaattgttcctgctgaaaaactttggtcttagtttcatttagtatagataacatggccttttaatattgtattatttatatttatttgattatcaaaaatgactatgtcggcatccttaccgatttctaaagaacctttttctttgtcaatatgaagaatacgggcgggcgtcagggtcatcatacggacggcgtcaatgagaggaacaccggctaaatatatcatggttcgaaccagccggtcggttgttgcaacactaccggcaaaagctttccgatccggcattttggccactccgtcttcgataatgactttctggccattgttgaggctacctaatatcgattcaccgtccggcatacccgctcctctcatggcatcagtgcagagggctgttttatcaactcctttgaacttgtatacgaattggagcaggggtttcggaagatgtatgccatcggcaataatctccactgtcatatcttcaatcaagtaggcggcttctactactccggcatagcggaaagcatttttgcgggtcactgatgacatggccgaataaaggtgggtcacatgtgtataacctgctgtaaaggctttctcaacttcttcataaatcgcgtcggtatgagcgatggagggcagaatatgatgttgttgcagagtttgccctagtgctagagcaccctccaactctggagctacgctccaacggataatatcttttgaggcttccagaatggcattgtattcttcagcttgcggctttttcaggaagttcgggtcttgcgcaccacattgtttcggtgaaaagtaaggtccttccaaatgtaaaccgataaactgcgaaccattgatattcatttctttggctttccgatatacggtaaacgtcgtcattaactcctcgttagtgctggtaagtgtggtgggaaccattgcggtagtaccatacttggcatgtgtttcggccactccgagaaaagcctcgacagtaccatccatgaagtcatgtcctcctcctccgtggatatgcatgtcgatgaatcctggtgaaacataattctgacgggcgtctattaccttgtcaccaacgagcggttgatagctttcattgggaataatctgctcaatttttccattttcgcatatcaatgtttggcccatttctatgcctgttggtagaatgagttttccatttgttatgatgagtctttccatattatttcgtttttaatttatttccaggagtctattttatgacctttaactgcaaagaaaaccaaatataaaaaacagggaatcaatacccaataaccgaaacgcagactatacatatctgccagatgaccatatatcagaggcagaatggcattgccacataatcccataataagaagagaggaaccggttttggtgaattttcctagtccatgaatggaaagtggccagatacctgcgtagattaaagcattcgggaaacccaatgcattcagaaagaaaatggaggcattggcatgatgaccgaacagagttacttcaaaatctgcaaatacaactccgaatgaaaggagtaatccgatgatggtacaacctataagtgcatttttttgtgaaacatatttgggtattaacaggatccccaggaggtaaccaatcatagtacaggccaatgtatatgagggaaatgttttagcttcgagcaggtccatacccatcgaattggcataattgatgattgtatcaattgcgataacctgtgttcctacatgaagaaatatagccactgctcccaagataaggtagggaaagtcgaaaatactttttctggtgtgatggtggctacctgtatcttccgtgctgttttcttcgtctgtattgatttcaggcagaatggagtaacggataccgataccggtaagcagtaaaataacgcctagaacagcataaggcacaatgacgcgttgtattaattcgtcaagcatagcattctttgtgactatgtctaaagtccccgattctatagtggcaaaaagctccttgtcggtaacatttaatatcaatgcagcaaatatgagtggtgagacgatacctgcgaatttattgcatattcccataatactgattcgtttggcggcactatcaataggaccgataatagtgacataaggattagcggcagtttgcaatatggctaatccggtgccgatggaaaatagaccggccaggaatatctcgaattgacgggctaatgctgccggaacaaataagaaagctcctaaggcggtaagcataaaaccatacataatacctcgcttgaatcccactttcttgagaagtactcccgaggggatagccattacaaagtaggcgatataaaatgcaaaggcgacaaagtaggattcgaaatgtgtcagttcacaggatatgcggaagtatggaatcagtatggcattgacccacgacacaaatccgaagataaagaacatccctgccagaattgcaattgatatgtagtatgtctttttgctgcttataaggttattgtttcccatgtgtttttattttttcagttcgaaatctttctgtaatttgatgtcccgtgacgatgcgcctattaatactgtaaacatgccaggttcgtctttccagcatttactttcggtatcgtagtattgtaaggcgcggcgcggtaacttgatagtgacttgtttggattcacccggttttaagccaaccttagtgaacccttttaattctttaaacgggcgttctacagaacatttgttttgatgcaaatataactgtgcaatttcctggccatatcgttttcccgtgttagtaatggtgaatgatacggcaaactctgtgtccgagtctttccatacaggtttcatctttatgtttgaataagtaaaagtggtataggataatccataaccgaattcaaattgggggactacacggtaagtatcgaagtagcggtagccgaccataagcccttccttgaaacggacggtgtcgtttatacccggatattctccaaatacgtgatcaggcatatcttccagacgcttacaccaggtagtagtcagttttcccgaaggattgacttctccaaacaatgtacgtgccagtgcatttcctccttccatccctagaaaactgccgtgcagtaatgccgtagcatcattataccattctcctatttcgacggggccaccggagattagtaccactacagtgttgggattaacctccaggataccttttaataatctgtcctgttggtaaggaagctttaaattcggcttatcgtacccttcacagtcagaaccatgttcgtgggaggttccacctatatagataaccaattctgcttgggcagctgtattgattgctttcttatatagctcttcatcggatttatcaaattcgttcgtgaaccaatgaccaaccttatacgcctttttactcaattgataaccgggtgcatattcgatccgggcttttccatctaaaagattttgtagcccttccaaaggagtaacttcatatttagctttaagttttgtactgccacctcctgctgcaaatacttcggttgcatttgcgccaatcactgcgacattcttgtattgtgccgggtctagtggtagcatatctttggaattcttcaataataccaatgattcctccgctatttctctggcagccttagtatgggcaggtattgcaagtttggctgccatacctgtagtgtcataaggaacttgtcctattaaatcaagtcgaatcatcaatttcagaatattacgtacttttttgttgacggcttcttccggaatctctccattacgtactttcttcaataaaggatcggccaaataatatttattgaaagcatatttcccattttctttgatgcttgttcccatttcgacatccataccgcacagagctgttcgctctgtgttatggactgcattccagtccgatacgactaatccgtcaaatcctagttcatcacgaagtaaagtatcaagaagataaggactttccgtacaccacaaccctcgaaccttgttatatgccgccatggctgccatggctccacctcgttgtatggcagcttcaaaagccggaagataaatttcgtgtaaggtgcgttcgtctacttctacactcactttgtactggttgtatgcctggctattcagagcaaaatgcttcacacaagaggctactccctgtgactgtactccttgtatatatggaacagccagttcaccggagaagaaaggatcctcgctgaaatattcccaattacgtccattgagtaaggaacggtgaatgttgactcccggagccaggctcacatgcttaccgcgtgctttacattcagctccaagaacttctccatatagctgtgccagatcacggttccaagtagatgctaaggcgcttaatgcaggtagatagctacatgcgtcgttatcccatcgggcggattcccacccattggctactccctcaaatcttactccgtgaggtccgtcggagtagtgcaggtcggggatgccaagccttggaacaccggtacttgaaaacatcgtgttactgtgcaacattccaattttctcttccaaagtcatttgtgataataaactttctatctgtttatcagtacttgctactttattaccagtcagacaggaggagaatataatcagaatcagccagctatatggagtcagtcttttcatactagaatacttgttgtctttgattattttgaattattctttcttgtttcaatttcactgtacacagcatccgggatcaaatcaagccagtaaggatcctggacgagttccttgtacagttcaagtgccagagggtcactttgcagacggcggtcaccattctctgcattttcgtgattctcccatacgacggccttgacacgtggctcttcatccttcagcttaaaccattctcttacccatctctggtggtcgcatgtgctggagtatcctccttcactaatcatgataggcttgtctgccgatacctgcttgattccttgcatcagtgtgagcggatatcttctttcttccggataagtagcactaagcgatggtggataacagcttactcccagccaatctacatacatatctcctggataatagtttttcattgcgtttgcttctgtacctggcatgcttacactgttgggtgaccatacgaagacattgtaggcagtgacacccaactgttctgcaatgttatacatacgtctccaagccttgacatagtttgtgggatctccgtaatacggagtccagcttccattcatttcgttggctggtctgaaccagataggtcccatgtcacgtacttcttgggcagctacttcggcgaagtatgatttgtgaaaatcgtcgagttcgccatttgccatttgttgggtgggaatgacgggcagccatccgtaaaggaagaatcggtatttgccctgatagttttttccccagtatttctcacgtactgtttgcatttcgctgaaatttcgtcccggttccatattctgataccataagatcatagatagttgctttcccaccaatttttcaaataaggcaacggcacactggtcagtacttccttcgcggtcttccggatcgaatccgtataatggtgggaatgctccatgataacaccctttttcggggacgtacttcatgtcattatgaaattctcccattaccttgatttcgtcgatgagcatcatcgtactggtggaagctgaagatttgagagtcgctttcacatatctgcatgctacattactaaagtctgtttttccccaagcgtccgactttccgttgctgtcggaataggtaattggtgaggctgctttttcccattggcttttgtccttgctggttgatacttctatttgagcagggaatacaatttgtgatgtcggatcggaaatagcatgtactgatacttctgtgatattgcgtaatgatcccaaatcaattataacttctacagtttgtgcatcccaaccgactcctctgtttttagtcgagagggtaccggtctcctcatccgtcagtttggtgccggatgtccagggatcgagaggggctttatcagcataggcactgttggctacaacattcattttatagaatttgcctgccgccacattaataatgctttgttcatttggatctttgggcttatttggatcaaaagtaacttcccatgatctcgtttcttctgcattgcaagcgtatatgagtattgcaactgctattaaccataaattttttaatttcatatttagtggtatattataaggttgattactggttgtttgtattacatatcaatacagtcatattggtagcaggcgatgcctccattagagaatacgagataaacgtatagataataaccatttttggcaactttaaatacgacatctccggttccttcggtgttttgaccggaattctcgcgacctccatatatcttgtccggacatactattatttggttgtcgaacgagccgctactaagatcatacatacggacagcatcagaaccagttacggcatagttgaaactatttacatgattgtaaatgatataaggtactttgttgaacacggcatagtctacggcattgataattgtgttacccggagcacccgtatttgccgcttttatgctattgtctgttcctttaaaccagtagaaatagcgtttggcagaagtatctgtgacatggctggccaagaaatagtcactttgagtatcggtgtcatcagcataaatcacatccgcccatttaatccagtttgaagtcagtagagaggaactcataatgacaaattccggactttgtgattgtaaagtaccatttatgacacgccaacgggcgaattgcactttactatccttttggaatactggagttgtgataagggcattggcatccaaatctccctggatagagatcttccaaccaaatcttatattagtgccagttttatattcaatatatttctgtggtttctcattcactccattagctttccatacggtgaaagtacctcctgatggagtatagctgcagaataaaatattatttccccgatctgctgttgcatggaagtttgaattgtcaccggcaaattggctgatatccatagaacctgctatttctccggtctggctatttaagtaaatggcacgatcattggcacgttcgttgatgacaacatatttgtcgactactgcaagtccagttactttacccggtagcagaataccgcttatttcagatagtcttttagaccataatagcttaccgcttccttggcggatacctgcaacagttttttgcggaatatctttttttaccgtatatgttgctttatctatgccattctgtgctgtgacgacgatggtctgttcttgttcatagtctagtgcttctgtttcggggttgggactgcatgttgctccatgtgagatatcaatgttagctatctgctcccctacattatctatggttactaatgaaattgttttttcgttttcattaatgactcccaatagccctatggcaggaatatcgaatttggtgatgctacattcgttgctcttacggatttcacctattactttgaattcggtactagtcccggaggtctgatctttcactgtgatatagttgtcttgggtaagatccatataaagtaatggtggagttacactgacattattcgctaaactggcactcaatcttacccgttttagtgcagaggtcggcaatacattatccgacaatttgggataattgtatgggaaaacaaatgtgattgaatgattggtataatctatctcacctttgaaactattttcgctgctgtcatcgttcggaaacgatgcagtgatgctgttgataccttcgcgttgaatgtcagaacccaactcttcaggactgtgacaactagttactccccatagaagaactaatgcctggatgattgatataattttgtttttcattgttctaagagttttattgttatttccattcatcatattgctcaatcaatgagttattcttcaattcttcagacggtacaggaaggacatataatttctttataaacttgcggtcctgcccgtcgcaatcaacatattcgtatgtattggtagcgccaatgattttgaagccatgtgtgcgatagttgttgtattcaatatgggctaattcccaacgacgcatatcccagaataaatgaccttcataggctagttcaacctttctttcatttctgtaatctttgaaccaagcctcgcctgtagaggatttacccggtaaattcacttttactctggcgcgtacctcattcattgcactttgggcttccccgatcttattgagtcgataagctgcttctgctttgttcaataaaacttctgcatagcgaatttcaacccacggttgggcgcttttcccatttttgacgtctgttagcgtttcatctaacaatttccttaaaaaataaccggttgtggttttgccgtatgaagtaccctgttcccggtaaggcataaacacaccattctttccgtcaaggctgcaatccatctttttccctttccaggtacatcctctatagattacagttgcggcgaagcgaggttccagttggtcgtatggaggagtttcatcagtaatgccatgccagggtgtccagtctatcttttctccatttttgctttcataacattctaccatttcctgggtaggagttcctgttgaaccattgtcataaccatcacattgtggtacataataccggtcgaaaagatgattaggcccgttggcagcatcataatcaaactccagaatcgcttctttattattccctttccatgcatcttcatatttgtccgtcagaccatatagtttgagtgcaattacattattagcagcatcataggcatcctgccaacgtttggcatataacatagctcttgatttcagtgcataggctgctcctttggtgatacgccctttatttgccgcatcccattccttgggtaaattattggctgcaaaatcaagatcgtcagctatgaattgccaggtttcttcagcactgctgcgggctttattagttgataccggcagatcgtcatacaagatgacacctccatgtcttttggctaactggaaatatacaaatgcacggaaaaagcgtacttgagcttcccaaagcttatttctgtctgctgaaaattcggaatattttctttgtagagatagaaattggtttgtttctcggatctgtttgtatgctgttgaacgtagccagatactgtatagacagttatccggagagatagcatccggtgtaagtacataaagattaggatggccggctctgtgtcccagcgtatatgaaccatacttaaatgcgtcagtcagactttctgtaaaacttccgtagaattgggcctccccgaattgaccgtaatcatgcaggaggggatagaaactattcacatatttgtcaacctgggtttcatcttgccagatgatttcatcactaacggtagtcgtttgttttacttcatccagccagtcgttgcacgaacttaaagtcagcaacataaagaagagtgatatattaatacataactttttcatatagcgtatattttagaatgtgattttagctccaagtgtataagtcctttgttgcggataatatccattgtttacagctggagattccgggtcgatgttgtacttggacacagcgctgaaagtcagaaggttgtatccctcaacatagaggcgaagagcttccactcccaatgggctcaaccattttttagggaaattgtatcctatttgtgctgtttttattctcaaatagtttccgttacgataccagaatgtggaggccagcccgttattcaaacttctcggattgatttccagacaagggaactctgcatttgtattttcgggtgtccaggagtttgccaccagatagactggtgcattgccattctgatagaatggacgcgtgaaggccgtagcgctttggattccggatgaaccggttgccgtatatactccggttaatgcaacatcgctgccaagcccccatgatgccaaaatatcaaaatcgaatcctttccagttaccgaataaattgaaagaacctgtgtgggtcggtcttgagcttttacctacatacccttgatcttgattgactgttataataccgtctccatttctatccatatacttgatatatccgggataagccggtcggtcgggcatggtagcggagttggctatctcttcctcactctggaacaatccttgggcaatgaatcccattttcgaaccgatttgctttccggtcagtcgtctgtattccggtgtgttttcagagtcacctgcatatttgagccaccttccgtatgcgtatgaccagattaatttggctccatagctgaaacttccgattctgttctgatgtgtaaaggtgacatcaaaacccttataatctgctttattaacgttggcagttgaaaaataatagcctcccatggaaggagtgtgcgaaccggttacagaagataatttgtcatattcatatttataaaaagcatccagttccattcctaataatccattccataaagttacatctactccgatattatagttgaggcattgcgcccatgtcaaattgggatttcccaatacggacggatagatagcagtttgactggctccgcctattactacagaattgggggatgtgctcatcgtatttctccattggaaaggctggataccgctggttgcagtttttccaatacctgctcttaatttcagattgtctacccaagtagcatgaaaccatttttcattattgattctccaggcaagagagagaccgggcagggtgacccagcgtttgttcataccaccaaacagataactaccatcgtggcgtagtgaagcctccaaataatatttgtcagcgtaattgtagttcaaacgacctacaaaaccggctacacgtgtctggctgctgctacccgaaggtatagcaggttgctctttcccctctttggtgaatcctgtgatttggttcaactcatccaactgaatgaaatctaatccggttcccgttacaccgagattgttgctattacgttcccgtgtttcggccagtaataatactccgatcgagtgatctccaaatttgttatcatacgtgatactggtttgcgtagtgaactcttgggcgcgtgatgccgattcggataatataggtgtatctttcaaaacactgtagtccttatggtaggtgagtgtggtagtggctgcattaggtaaatccataatcatgacttcattcggcttggtcaactgtttagtcatcccatgaactaagtcgtacgctccctggaattttaaacttaatcctttaagccaaggtgtgtcgtatttcagactgaaattagactgcatatatgattggttggacctgttatatcctgaatcgtatatggatgcgataggagctaccggagaaccggaagtcggggttgaaacatcgtatattttcccattatattcataagtgtcctgtacgtatggcaaagcatagcatacctgttggggaatattcatccaatcatccggatcggcagaaaatttgggagcatcccgtttttctatacgccccgaaacacctaatgacagactaagtcctttagccaactgtgcatcgatattagaacgaagattcattcgacggtatttgaacttatctatatttcctttttcttccagataaccgatagatgtgaagaaacgaatcttttcacttcctcctgatgctgaaatattatgatgttggcgaacaccggttccatatactttatcgtaccaattggtatttccccatccgtcgacaccctcgcgcattttgcgcaccatgtcgacagtaaacacttccgtatcaccttgtagaagacgggctttattgtaccaataagcatatcccggtccgtcgagccattcttgttcttctgcattctggctgatacccacagtacctgtatagctaatggtgactttatctgtttgtccctttttggttgtgacaatgaatgctccatttgcgtccagaccataaacggctacggctgatgcatcctttaatacagacacagattctatttcattcggatcgagtccgttgaagtcacttgcgcttcttctgatgccgtcaataacatagataataccactttgcccgcgtatagacaaggaggcattatccgcaccgggttgtccactggcttgtacggcggaaataccggcaacacgtgcaccgatgatattactgattcccatggttggggctttaaggatttctttatcggagacagtagatatggcggcggtcagactaccgcgcttttgagttccatagcctaccactacgatttcatccagcgaggaaacatcttctttaagagtgatattgatattcgtcttattacctactttgacttcctggctgaccattccgatataggagaataccaatacgtcattcttatgggcattaatgctatatttgccgtcaacatttgtaatggtaccgacattcgttgcacccttgacagctacagatacgccaggtaatggttcatcattaccatctttcacaaacccttttattacttcttgtgcaagacaatcgagagtgcacattaaaagagtaataaacaacgaggttactaaccttggattccatctgattttcttcattgcatgataagtttttaaatattagatcgtcgatttgaaattttaatttctaacaatagtctctttagaccggttaactagttaatgatacaaaagtattctgtttcaaagatatgtgcggtggcaaaaacgaaaaactatcttcaaaaaacgaagaataatgcatcgttaatcttcttttggcgtttttctttttaagaaccattcgaagaacttatatatagtttcgtttgattcgggagtaggatcatgtttgggcctgttcgtcattgccactcgatgatgataacccaaaagtcggttgactgcaacagagtgatttaatggaatccatctgtctacattatcagaataacctcctgatacgagaaatgggcgaggagccaataaagaatggagttcatgtaaatcatgcccctctttacatagtctggcatagacacttgttgaagagttattgccgttgttgctccagatctttttccagggtgggggataataccccaagtaccaaggttcccaataattgatataattatctttggtttcatcaaagacgatacccggatcactccaggcggtgcaggcaaacttttcatataaacaagaagcaaacatagcccatttagcaccgtaagagtgtcccatgataccaattcgggtagagtcgacactttcgactctggctaatacttcccatgcattggctgccgcataagcaagtactgaaagaggttgcatagtggagttgttaatagtcgggtaatagagagagtaagtcttatctttggtggtctgtctagttcctaatgagagagtaacgaatcctcttttggttaattggtaggcgaaatctctattagcttttcctccccatccgatagctgtttccggttcgtagaatactgtgataacggcaggatgtttccctttcttatttggttccagtaaatagccgtaagtctgttccagaggagtccaataaaaacgcactaaatgttgtttgaaatcttcgcgttctgtggtttttataatctccagtttttgattggtgatgatagccggccaatgaccgatcaggttcaaccatttgtcttttatttcttttcttcgttttagccaatcgtctgcgtttttgactgtatctccattgtaaaataaaagaggattgcggtaagttccaaatttctcctgatacagtggtggtggggtaaagtaggcggatagcttctcccagtttctttttgtctggttaatctctaatcttttgcaccccattattgaggtgacccccaaataaataataataggatagataatcgttcttgtttttcctcttatggtatgtctttgcatagtattaatatctaaaatgtatttcgaaaggtatgaaaacaaaggtaggtcattctcatgaatgatcttaatgtcaaaacgaaaaacagtcttcagaaagcgtttattttatctttgtctagtctttttctgccggtattcaataggtgaacatcctttgaattttttgaaaatccgggcaatgttattatagtctgtaaagcctacttccattgctaaatcggccaatggacggtcggttgtgagcagtagatctgcaagatgattacaccggcaattcagaatatattggtatatagaggtattcagtgcgtttttgaatttcacttcgaagtttctgcgggatagcggaatgtttgcaagcagagactctatggtcaaatcggaactgtaatgagactctatatacttcactacttccagaatataagggtctttgatattgtgtttctccgtagattgccgtaattcgatgcggataggattgataacaatattgaaagtaccttcgtgttccttttttatttgttgatgaataagtctgccgatagaatatccgcctctttctacttcgagctctatggatgaaatgggagggtcggaaatattacacatcagttcgtcattgtccacgcctaataaagcaatttcttccggaataggaatattcgtcattttgcaagtttcagaaatgaatagggcgtgcgcatcatcacaacaaaatagagcgactggcttggggagttgctgcaaccattggctgacttccattcttatctcgtcttcctgcttatccgattcgaaactgaaaaattcgcctccgatgcgttttacttcctgccgatacccttcgcaacgttcgtcagaccaaaccacccctttaacgccgaaataagcaaaattgcgaaacattctcttggcaaaaaactgggctgccattcttcccgttcctttatagtcgcctgtcagattagagtaagtgacgctccggtgatggtagttttgtagtactaccggaatattcagctccttctgcaaatcgatcgtatcattattccactgaccgataatggcgtcggctttccattctttcgcccatcttaaaatgccttgttcaccatgcattgcgctataataagaaggtagtcggtaaaagagccaggggccgttttctttggagtattggacaagtccccgtagcagtttcctgtcaaattcgcttgaatagtctatcaatagaagaatcttaatcatagttctatgtttttctttagtataatgtagggatgcacaaatatagaagaattcctttgttttcctataataaaaacttaattttgtagcaagaaaaacttgtatgacacccgggtctcgtgctgtacgacacccgggtgttgttgtgttcgacacccgggtctcagtatgcatgacacccgggtgtcgtacaaattatgataactaacttaaaaagaaaggagcgtaagattatgtctatcccttatgtagtgagaaagaaagcggatttatcatccggagaacggaaagagttatggtatggtgtacctagtaaaatgcagcgaagaggaggagtgaaaaataaagaacttgcagtacggatggcaaagacaacaggctttcatcgtgggcagatagaaggaatcctgtcggagttggttgaaagtattcaagacctgctttcctccggtcattcggtgaccattgagggattgggaacctttcaaacggcactgaccagtcagggatgtgtgctgcccgaacaggtaacgccggggaaagttgctatttcacgcgtatattttgtggcaaactcaaaattcagcagggaactgaagaagacaaagtgtacccgcataccttttaaatattatatgcccgaaagtatgctaacgaaaaatatgaagaaagcagaccgggaactggaacaaacagaatacgacatagaagagccggaaatcgacgaatagttgaataaaaaacaatattgtcttgttaattgaacagaattagattatatttgttcagtggttagaacaatatcttgaaatatgattagaagagaaatactaaaagaagttctattagataatagaaatgaggtggtcaaacatcaagttatacctcgtagctttcagtttgaagagtttggaaattatgtatttgtaggtatccggcgagcaggaaaatcatttttactttatcaacggatacaggaacttttgcataatgggcatacttggaatgaaatgctatatgtgaactttgaagatgaacgtttgattggaatgacggcggcagatttaaatctcatactggaagtacatgccgagatgtcaacagacaggccgatgcttttcttggatgaaattcagaatattgatggttgggacaagtttgttcggcgattggctgataataaatatagggcttatgtgacaggaagcaatgctaaaatgcttagtcaggatgtagctaccactttggggggacgatacattacagtacatgtatacccttatgattttaaagagtttctttatgctaatggggttgaagttacagagaattctttgtttgcaacagagagccgggcagaaataaagcgtatattcaatgattattttcgttccggtggttttccggaaggggcatcgcttgccgcaaaacgggattatctgacaagtgtttaccaaaagatatatttaggagatattgctgcaagacattccatcgaaaatacttttgctttacgcatccttttccgcaaattggccgaaagtataaagcaaccggtttcgtttactcgtataactaatattgttgcttcaaccggagtgaaaatatcgaagaatactgtcattaactacatggaatatgccaaagatgcttgcttgctgattcctatacaaaatattgcggataaattggtggagcgtgaaactaatccgaaatattattttgcggataatggcattctcaatttgcttcttttggatgctgatacctcgttgcttgagaatttggttgctgtgacactattgcggcgttatgggacggacgatgctgtattcttttataatagaaatgtagaggttgatttttatttgcctgatacaggagtggctatacaggtctgttataccatgaatctctctgatgagactttccaacgggaagttcaggcattagtaaaattgaataaggtatttgaatgtcggcagttattgataataacgtatgacgatgaagaacggattgagttggaaaaatgtgcgattgaggtaataccggtttggaagtggttgttgggtaaataagataaattaataccctccctgtcttatttatgagataaatccctatctttgtggcactttttacgaaaaaagcaaattcaaattaatagatatagaaaagaaaatggcacaagaagacgtttttaagaagcttgtatcgcattgcaaagagtatggtttcgtattcccttcgagcgatatctacgacggactaggcgctgtgtatgactacggtcagatgggcgttgaattgaaaaataacatcaagaaatactggtgggacagcatggtgctgttgcacgagaacattgtcggtatcgactctgccatctttatgcatcctactatctggaaggcttccggacacgtagacgcattcaatgaccctttgattgacaataaagactctaagaaacgttatcgtgctgacgtgttgatcgaagatcagctggctaagtatgacgataaaatcaataaagaagtagcgaaagctgccaagagattcggcgaatcttttgatgaggctcaattccgttctaccaacggacgtgtattggagcatcaggcaaaacgtgacgcacttcacactcgctttgctaaagctctgaacgacggtaatctggaagaattgcgtcagatcattattgatgaagaaatcgtatgcccgatctccggtacaaagaactggacagaagttcgtcagtttaatctgatgttctctactgaaatgggttctacttccgaaggagccatgaaaatttatcttcgtccggaaactgcacagggtatttttgtaaactacctcaatgtacagaagacagggcgtatgaaagttcctttcggtatcgcacagattggtaaggctttccgtaacgagatcgttgcccgtcagttcatcttccgtatgcgtgagttcgaacagatggaaatgcagttctttgtaaaaccgggaactgaacttgactggttcaagaaatggaaagaaatccgtttgaaatggcataaagctcttggattcggcgatgcaagctatcgttatcacgatcacgataaactggctcattacgcaaatgccgctactgatatcgaattcctgatgccgttcggattcaaagaagtggaaggtatccactctcgtactaacttcgacttgtctcaacatgagaagttctccggcaagagcatcaaatacttcgatccggaactgaacgagtcttatactccgtacgtaatcgaaacttctatcggtgttgaccgtatgttccttagcatcatgagcgcatcttattgcgaagagcaattggagaatggtgaaagccgtgtggttctgaaattgcctgctgctttggctccggtgaaactggcagttatgccgttggtaaagaaagacggcctgcctgaaaaagcccgtgaggttattgacagcctgaagttccacttccattgccaatatgacgaaaaggatagtatcggtaagcgttatcgccgtcaggatgctattggtactccgtactgtgtaacagtcgatcatcagacattagaagataactgcgtgacattgcgtaatcgcgataccatgcaacaagagcgtgtagctatctctgaactgaataatatcatcgcagacagagtaagcatcacttctctattgaaaactttacaataaacctttaacgaatgagtaaaaagatctatttattctccttagtattgttggctcttgcattcactgcttgcagtgagacggaagagactagccgttacgataattggcaggcacgtggtgtagcttttattgattcaatagctaatgtttataacagcccagaaaatcaggctttggctaatgatgatccggagaaacttcatgcttttccagatccgacgaataatcagactatatatgtaaagaagataaaaaagggggagggtacagaatctcctaaatatacttctacagtaagtgcacattaccgtatgttttatttcaatggagatgtagttcagcagacttatacaggaacagaaccgacagagtttgattctccggctatctttgtcctaagttctcctgaccctaatgttgggaaggtaatttcgggatgggcttacacgttgattcatatggtggctggtgatttttggactttgtatattccttatcaaagtgggtacggttctggtactggtaacgatggctctttgcagccttattctgcattagtatataatgttagattggaaaagatcgtagagaagtaattctataacaatataataaatgtaaatataggtgttgcgtctaaacgatacaacacctatattctttgtaaaaaaatggtagtctaggttttatttctttttaccaaagagtatgtgctatatttagaatatttttatattataaatagtgtttctatcaactatcattgctcctctataattttcacctgtatttagtttgcgactagttgttgtacctgttggaggtagtcctcctgtattttttttagctcgatgcatccatagggttgcagtattcgcattttttccgttttcatcatcaataaataattgatgaggtagcacgggaccttgctctggtttgcttaatactccgaagccagttaaggtatatgttggattattgctaaatctccaataaaattcagtgtttttatcgaatctagagattccagtagacgttaatccaccattgtttactatgtgatttttattgttatgatcttcattatcatggtgtcttaatacaacgtctacatccccttcttctggagtccatgtgtaattatgtaaaagtaaagccccaccttcataatttcctactggtactaagcagaaatgaaatgttacattgccatttccatcaacatatgttgctccaatatcacctatagatttagtgtcaccgccatcttcacaatccatgtggtatacaaattcacggtaactaccacatgaattaattttaaagactccggcgatttttgctatactagtgtaagctttagcttcgcttctaactttaccaaaattagaagtttttgtttcttctgatgctttttctaaagcatcaattagccatggttctgcatctgtttcttcttgtgttgtcggagtcgattcatctttttcttttttcaattcatcaagagaatagccttttaagacaagttcatagtcgttgatcatgtttgccaactcttcgttatttgtacttatatcttgcaattcttcatctgaagagcaagacgctaataaagcacagaaacataaaaagataatttttttcataatacatttttttagtgagtaatgttattttaaaagttcttcatcaattagatgacagatttcttcttttgagttagaattaacaattaatcgtccattgatgattatagttggggttgcgtatatgcctagaagtactaattggttaatcgttttctcgatagattttttcccttcattattagtaatatcattttggaatttgttaatatccatagacatattctgtgctatattaaatgcggctatagaatctatgtatcccttatatgtatataatgaatcatgaaattcccaaaatttgttttgtttgttagcggcatcacttgctatttgagcaaatgttggcattgtagagtaatggatatatccaaatttcactttgtctttgtactcttgatgtattgagtcgtataaagaatgtgcattaatacaggcgtcacaatcaaaatctgatataataatcatggaaacttttgattggagatttcctctataataagtatgcaaactatttaaatcaatagaaggacttttaggaggatagagatattggagtatctttttgttcctttttaaagaatcaagtaactcattgacaatagctccctttaaatgaaacaatcgtgtcactttcccagtaggagagcctattggtacactgtatgcactcttcccacgaaattccgtgattgaatttatattatatcgttttaaaagagagtctgtacctgttttcttaatttttgcatctgtatattcatctatatattgttgataagtgagctgttttttatttgcctctttctgtaatagcttaacattgattagttgctccaatgcttcctttttaatattatgaattctgcaaagttcgtcgtaaagctcttgttttataattgtgtttatctcactggcatatattgcttctccatcaaattcagctataatatctttctcggtacctttggaactttgatgggagttgcaagatgcatagaataacaccatcagcatggctgatatgtagtatggaataagtctcatagtgtacttcaatctattgtaaatactcctgttgcggaccacgaagacgatgatatctcaagagtatattcagcacttttatcttctccaaataaatcaatgagtctgtacttttctaaagatgtacttttctcctgatagattgtttgtcctgtttctgaattaattattgtgattgttacgtctttggatggattctcaaattcaatctctaataatgaattactgacataaactcgtgccggatcaaggtgattagtagagcgatgctctatcggttgtctaactttcatctttatttgtcttcttgtgtctgatggcattgaaaagataaagctagagcaaagagccatgaatgtgaataaaagtagatttcgtttcataatagttttattgttattgattttcagcaaaagtaggatgatttgctatatgttacaataacaaataataacaatgtgattatatatagctattggtaatcagtgtgttataaaatatatataacaaaaaactaattgtgataacagggcattgtgtttatttacttgctttctcctttagcatcgaaaattatagagaaactaaggtcagataattgtttttttatacgatatttcctttgagtcagtgcagactggcttccggctttcatacaaactttgattgtattattggataattggaggtagttaagtatgcagtaatagagatcgtcttgtgttagactagggtattgttctaataactcttgcatcgcttcaatgaaggcttcgtttatttcttgataaatcagtgataactcttcttgagttatctctttctcttttttgtttttagatgtttctattgattgaatttttttataagatgtagtcgttttgaatagacgtacgcatatctgaagactttgatgccataactttattctttgatttaatatatctgcatatctgtgttcattgatttcattggcatgagatagtgctctgatttcttcttttaatgtggctttttctgtctgattcttcattagtagctgctgccagtgtatatgtgtctttttattgcgattgcttatatacattacagtatagataaacagaaacattgtaactaatccaccaataatgaatattacttttgtttgttgtgattgtttttttatttgttctttatatatatctattgagtgttttttgatgagattgttaatttcagtatggtgaataattttctggatagagtcatagcaggttaaagctgtatcgttatatagaattgcctgttcataatttttgttttctttgtttatttcatacaaagtctgataaatagaagctttagtataaatattggccttagtactagctcgggataaatagtgaatagcagaatcagtttcttcgagattatacaatatacttcctttccaaaagtaagtaggagataaattaatgttagaaggagcatatctcaaggctaaatctatttgctttttagcttctatatataacccttggtcgtcatatacctttgctatatcacaaaaaattgcattttcccacaatgaatctttgatagattgtgctattgataatgctttttgataataagataatgctttttcttcctcatcttgtattgcataaacattgcctaatcctcgggttgcgtgtaaaattccatatttgtcttgcattttttctgcagttgcgtatgattctttatatgttttgatagccggaagataaaactcttgactctcgtaacataaagccaggttattgtatatttgtaatattggagcttggtttggggatgctgtttttaaagctgttagataggcttctgttgcttttacataatctttgttatcttgatacactcttccgagataataataagcttttgtttttagcttattattactgttatccttatagtagtcaactgctattagaattagagagtcattgcggtgagatttgaaattcttatctaaagcttctgttaataatagtgcatacatggcttttgctgatttattagatatttcttcaatagatagcttttccaatatgcataatgcgctgtcagcacgtttgtctattaatgaatctgctaattgtaattgaggggcagtgtttgaattatgacacgcattaaagaaaatgcatagtgttgtaattagaatagttaggtagttcggtttcatagagttttatctgtttctgcaaaagtaagtatttataaataaaaagtagaatcgtttgtctataaaacttcttttaataagacgtttcccttatttttttatgctactctccctaatctgcaaatgtgtcggaatcgtcacctgcttgatagtcttatctccttttatctgatcgataagtagttggcaggcagtttctcccattttataggtctgatgtgatactgctgataatttcggttccacataattagcatgctgctcgtctgtatacccgatgattgccacatcattcggaatccggaggccatgatttttgatgacttccattgctgcgaaagccaatgtgtcattcatggcaagaatagcgtccggaggctgtggaagtgacagtaaagtttctgtggcaatcttgccttcctcataatcaatcttccggcaaacaactagctctttttcgatgggaatacgattctcacgcaaggcttccagatagccatgttttcttctctttacaatatccaaatgattggctccaccgataaaggctacccgtttacttccattatccaacagatgttgtgttgccatttgcgctgattgtaccccatccgctacgaccgaagaaaactggtcggttaggcaaacacggtcgaacaggataagtggcatattgatgtcttttaaggcggagatgtgggagaaatcggttgtttcttgagacagacaggcaatgatgccttccacgcgcatattgaccagattctcaatatttcttttttcgtgctcgtaagactcatgcgaggtcgtgataatcacaaaatatccgttggcaatagccatattctctatcccattcagaattgatgcaaagaaatgagtgacaatatccggaacgatcactccgatgatacgtggcgcatttttccgcaggctcatggcaaaaggattgggacggtagttcatctctttagccagtgcctttgctttggcgcaaagttcacggctgatttccggactatcttttagtgccctggatacagtaggaatcgatacccccaatgcttgggcgagatctttgagtgaagtatgtttccggttttccatttgaaagtctgcaacttagattctttttacaaagaaagcacattcccggaaaattaaaagcatctgaagcaatattttttacgtaaaccgttacgttggtttttcgactgctctctgctgcactgaaactattactgacttatttttgtcgcatacaaaatgatttaaaacctaaaagtatgcaataccatgaaatcggaaagacagggatgaaagtatcatctcttagttttggagcttcttctttaggaggagttttccatgatttgaaagaaaaagaaggcattcaggctgtgtttaccgctgttgaggcaggaatgaactttatcgatgtgtctccttattacggacattataaagcggaaactgttttaggaaaggcgctaaaagatcttcctcgtaaccgttattacctttctaccaaagtgggacgttatggaaaagatggagtgaacctgtgggattactctgcaaaacgtgcgacagaaagtgtgtatgagagtatggaacgtttgaatatagattttatcgatctgataaatgtacacgatgtggagtttgccgatttgaatcaggtagttaatgagactctgcctgctttggttgagttgcgtgaaaaaggagtggtaggacacgttggaattaccgacttgcaactcgagaacctgaaatgggtaattgcccattcaccaagcggtacgattgaatctgtgcttagcttctgccattattgtctgtgtgataataaattagcagacttcctggactacttcgaatccaaagaaatcggtgtgattaatgcttctccgctttcaatgggactgttgagtgaacgtggcgtgcctgcttggcatccggctcccaaacccttggtagaggcttgccgtaaagcaatggaacattgcaaagctaagaattatccgattgagaaactggctatgcagttctccgtcagcaatccccgtatagcaacgactttatttagtacaactaatccggagaatgtgaaaaagaacatcgctttcatcgaagaacctattgactgggaactcgttcgggaagtgcaggagattatcggagagcagaaacgtgtaagttgggcaaactcataaaacagcgtcattcgtatggactatacaattattgatgcgcacgcccatctgtggttacgacaggatactgttgtggacggattgcctatccggactttggaaaatggccgttcggaatttatgggagaaatccggcaaatggttccgccctttatgatagacggagtgaatagcgcggaagtttttctttcgaatatggactatgcgcaagtggctgcggctgtcattacccaagagtttattgacggtattcagaatgattatttgtcggaagtcgtttcccattatcccaaccgtttctttgtttgcggaatgtgtgagtttcgtaaacctggatttttggagcaggcgaaagagcttatagccaaaggttttaaggctataaaaatccctgcccagcgcttgttgttaaaagagggacgggtaatgctgaataatgaggaaatgatgcagatgtttcattcgatggaagaacagaatgtcatgctttccatcgatttggctgacggagcaacacaggttcccgaaatggaagagattattcaggaatgtccccgcctaaaaatagctgtcgggcacttcggaatggtgacacgtccggactggaaagaacaaatccgcctggcacgtcatcccaatgtgatgattgaatccggcggaatcacctggcttttcaatgatgaattttatcctttcaaaggagcagtgaaagccattcgggaagcggcggatttagttggcatggagaaactgatgtggggatcggactatccgcgcaccattattgcaatcacctataagatgtcatacgattttatagtgaagtcttccgagctgacggaagaggataaaagactctttttgggagaaaatgcctggaacttctatggattcacggatctccccgtacttccttacatcaagaacatgtccgaatgatggagaaaacatccttatcgtaaaactatatttataccatgaaaaagaatacatatacaatacccttagcgttagttttctgccttttctttctttgggcgataagcagcaacctgcttcccacgatgatccggcaattgatgaagacatgtgaactgaatacctttgaagcctcctttaccgagactgcctactggttggcttattttattttccccatccccatagcgatgtttatgaaacgttacagctataaggcgggaattattttcggactggtattagcagcaatcggaggcctgcttttctttcctgccgccattttaaaagaatattgggcttacctctgtatcttctttattatcgctacgggaatgtgctttctggagacggctgccaatccgtatgtgacggttttaggagctcccgaaacagctccccgccgattgaatctggcgcagtctttcaatggactcggagcttttatcgctgccatgtttttgagtaagctcatccttagcggaactcattacacgcgagagacccttcctgtagattatccgggaggctggcaggcctatatccaattggaaacggatgccatgaaactcccttatctgatattggctatattgttgattgccatagctgttgtcttcatcttttcaaaattgccgaagattggggacgaaggagaaacggcttcttccgataaaacgacttcttcgggtaaaacgaaagagggtagccagaaagaaaaactgatagacttcggtgtattgaagcactcacatttgcggtggggagtgattgcgcaattcttctataacggcggacagacggcgataaacagtttgttcctggtttactgttgcacttatgccggattgccggaagatacagcgactaccttcttcggattgtatatgcttgcatttcttttggggcgttggatcggtaccggattgatggtgaaattccgtccacaggatatgctactggtttacgccttgatgaatattcttttgtgcggggcagtgatgatatggggaggtatgatcgggttatacgcaatgttggctatctctttctttatgtctataatgtatcccacgcagttctcattggcgctaaaaggactggggaatcagacaaagagcggttcggcatttctggtaatggctattgtcggcaatgcctgcctgccacagttgacggcttatttcatgcatgccaatgagcatatctattatatggcctattgtgtaccgatgatttgttttgtcttctgtgcatattacggctggaaaggttataaagtaatcgattaataaatttatttatcaaacatatccaatgaaagcagttcaaattgtcaatccctccgaaatgaaggtggttgaactggaaaaaccgaccgttggtgccggtgaagtattagtaagaatcaagtatgtgggtttctgtggctccgacctgaatacctttttaggacgtaacccaatggtgaagttaccggtaatcccaggacatgaggtcggagcggtgattgaggagattggtccgaatgttccggctggcttcgaaaaagggatgaacgtgacattgaatccatacaccaattgtggtaaatgtgcttcttgtcgtaatggtcgtgtcaatgcttgtgagcataatgaaacgttaggagtgcaacgcaatggagtgatgtgcgaatatgccgtattgccttggacgaagattattccggctggtaatatctctcctcgcgattgtgtgttgattgagccgatgagtgtcggattccatgcggtatctcgtgcgcaggtgatcgataatgaatatgtgatggttattggctgcggtatgattggtatcggtgccattgtacgtgctgctttgagaggggcaacggtcattgctgtcgacttggatgacgagaaactggaactggcgaaaaaggtaggtgcttcttatgtgattaactccaagacagaaaatgtacacgaacggatgcaacagataacagagggcttcggtgccgatgtggtgattgaagctgtcggcagtccggtcacttatgtgatggcggtggatgaagtcggatttacggggcgtgtggtttgcatcggttatgccaaaagcgaagtagctttccaaacgaaatatttcgttcagaaagaactggatattcgtggttccagaaatgcgttgccggcagatttccgtgcggttattaattatatgaaagaagggaattgtccggtggaagaactgatttcgaagatagcaaaaccggaaggagctttggaagctatgcaggaatggacggctaatccgggaaaggtgttccgtatactggttgagttctgataagttcttgtaataagaatagttgttgatactcgttgttccgggtatgtaataagtgagaggaggctgaatacagtctcctctctttgggagatagggtgatgtaacatgagtaaatatagatgtaacattcttcatttgatatgtagcatcacaaagaaatcatgtagcatactttgggcaatatatctgtttgcattttctatttttgtgatgtggaagataacaaggaacattttaaataattagctttcaaataatagataatgtagccagttaataaaaaaacgatgattatgctgaaaacaaaaatcaacactattctgctgtgtattctttttacattgttcttcccgctatcagccggagcacaataccgtaatcctattctttatgctgacgttcccgatatgtcggtgtgtcgcgcaggcgattacttttacatggtttccactactatgcacctgatgccgggagcgccaatcatgcgttcgccggacatgaaacattgggaaactatcagctacgtatttccccgcattgacgatggtccccgttatgatctgctcgaaggtactgcttacgggcaaggacaatgggcatcatccatccgctatcatgacggaaaattctatgtatggtttacagccaatggcgctcccggacgcgggtttgtctatactgcgacagatccggccggtccctggaaacttctttcgcgtcctccgcatttccatgacggttcgcttctgtttgatgatgacgggcgggtgtatctctttcacagtacaggacagcttacggagttgaaacccgatttgaccgatgtacttcccggtggcatcaatcagcaaatatttgaacgggatgctgacgaacaaggtctgttggaaggtagttccgtcatcaagcataatgggaaatattatttgctgatgatttctatggattggagtattcccggccgtctgcgtcgtgaagtatgctatcgtgccgataagattaccggaccttacgaaaagcgtgtcattcttgaaacggagtttgatgggcatggcggtgttggtcagggatgcatcgtagacgggaaaaacggtgaatggtacgggctgatttttcaggatcgtggcggggtagggcgtgtaccgtgtcttatgccttgtacatggacggaagatggttggcctatgctgggagacaaggacgggcacattccgaatgataccactttatcgtatatgtcaatggagggtatctgcggttcggatgatttttccgcttccgggctttccctctattggcagtggaatcataaccccgtcgatcaggcatggagccttaccgaccgtcccggatttctgcgtttgaaaacctcccgtgtggtagataacctgtttgttgctcccaatacgttgactcaacgtatggtaggaccgaaatgcatgggcactgtcagtctctctctgggggggatgaaagatggcgaccgtgcgggattatcggcttttaatggtgacagcggtgtgcttacgattgaaaaaaacggaaataaactgtctcttgtgatgagtgaacagaaaagtgtatttgagaaaacgaagcgtgccattagccgtgtggatatgaccgaacaagcccgtatacctcttaacaaagagcttgtctacttgcgtgtggaaggtgactttaccaatggacgggatgaggctcgtttttcttatagtcttgatgggaaaacatggctacctgtcggtctgcctattaagatgaagtttgactacacccgtatgttcatgggtagtaagtttgccatatttaactatgctacacgttccgtgggcggttatgtggatgtggactcttttgattattcgttctgtgatgcgtcaatgtaacaaacaaatatgtatttgtaaccaatgaaacattgttttattagaaaataggctatttttgtttccaaattaatcataactaataagtataatattatgaaaagaggttggataccgattatgggtgtttgtttggtgttatcgttttcggcatgtaagcaattgctgccttaccaggacacttctttagcggcggaacaacggacggaggatttgttgcctcggttgactttggaagaaaaagtatcaatcatgcaaaatgcgtcacctgctatccctcgactgggaattaaagaatatgagtggtggaatgaggcgttgcacggtgtgggacgtgccggattggctactgtttttccccagtctatcggtatgggagcttcttttaatgattcattattatatgaagtgttcaatgccacttccgatgaggctcgcgtaaaatcgcgtattttcggtgaaagcggcgtgctgaaacgctatcagggattaacattctggacaccgaatgtcaatatattccgtgaccctcgttggggacgcggtcaggaaacatacggtgaagacccttatctgacaggacaaatgggaatggctgtagtccgtggtttgcaaggaccggaagatgccagatatgataagctgcacgcatgtgccaagcactttgccgttcattcaggaccggagtggaaccggcatagttttgatgcggagaatatagatccccgggatttatgggaaacctatctgcctgcttttaaagatttggtacagaaagcgcatgtaaaggaagtgatgtgtgcctataatcgttttgagggagagccttgttgtggcagcaatcgcctgttgatgcaaatattgcgggatgaatggggatacaaaggcattgtagtctctgactgtggagcgatttctgatttctatagaccgggaacgcatgggactcatccggataaggaacacgcttcggccgctgctgtgcggacaggtacagaccttgaatgtggaagtgaatatgcttcactggcggatgctgtaaaagccggtttgattgacgaaaaagaaatagatatttcattgaaacgtttgttgacagcacgttttgaactgggagaaatggacgaacaaccggcttggtcggaaattccaacctctgtgttgaatagtaaggaacatcaggcattggctttgcgtatggctcgtgaatcattggtgctcttgcagaataaaaacaacatcctgcctctgaatacccatctgaaagtagccgttatgggacctaatgccaatgactccgtgatgcagtggggaaattataacggtattccggcacatacggttaccttattggaagctgtccgtgccaaactaccggaaggacaaatcatatacgaaccgggttgtgaccgtgtggacggaaagacactccaaagcctgtttgatgaatgtagcataaatggtaaacccggtttcttggcagaatattggaataatcgtaatcgtgaaggggaggtcgttgccaccgatcagatttcaactccgttccattttgcaacgacaggggctactacctttgctcctggggtggagataacagatttctcggctcgttatgaatctgtctttcgtccttcgcagtcgggtgatgttgctttccgtttccaactggatggtgaagtgactcttattatagatagtgaacaagtggctcggaaaatatatgttaagaatccgacgaacctctatacgttacaggcgaaagctggaaaagagtatcatatcgagattttattcaaacaacggaatgaaagggctacacttgattttgatttgggcaaagaggtcgggatcgacttgaacctcgcagtgaagaaagtaatggatgctgatgtgattctttttgcaggtggaatttctccaagtctggaaggtgaggaaatgccggtagaagttcccggatttaagggtggtgaccgtacggatattgaacttccagacgttcaacgtgatttgttgaaagctttgaagaaggctggtaaaaaggttgtctttatcaattattccggttcagctatcggactagtgcccgaaacgactacttgtgaagcgattctgcaggcatggtatccgggacaggcgggtggtacagctatcgttgatgctctttggggagagtataatcccggtggacgcctgccggtcactttctataaggatgtgaatcaattgccggactttgaagactattccatgaaggggcgtacctatcgatatatgcaacagcgaccactttttccattcggtcacgggttgagttatactgactttacttatggagaagctaaattgagcaagaatacaatcgccaaaggtgaaaatgtagtattgactattccggtaagtaatgtcggacaacgtgatggagaagaggtggttcaggtttatttgagacgtccgggtgataaggaaggtccccgttataccttgcgtgctttcaaacgcgttcatattccggcagggaaaactgaatcagtagctattcctcttaccggtgagaactttgaatggtttgatgtagagtcgaatacgatgtgtccgttggaaggtacttatgaattactgtatggaggaacttctgatagaaataagttgaaaacgattgtaatgaacgtacagtaatacctctttggaattttgtttatttttacagatagacaatccggatttatttattgaatgaataaagaaagaacgaccttgttcctttaaaaggaacgggtcgtttcttttaaaccaagcccccgtttcttttaaaccaacgggggctttcttttaaaggaaaatgaatatttgctaatgcttgatattcagtcttttacatgatgggggataaaagtgttgaaataataggtaatgtagtcatttatcttaccatttttctgttttggggctttttgttacatcagaaaagaatcatgttacatgtctgtgataaatgtaacctgtatatagatgcctgtatcatgattgtacatatatgataaaaccgaatcgatacatttgcaaacactactatggaacaggaaattatagaaaataaaaagtgataatatgagaacattaaaattgattttgtcgggctggcaatccgtggggcttgtcgtatttattatgttgttttttaatatggaggtgagtggcaagggtaaaataacgaaaaatgctcctgtctttacgcaatttatttatcagggggaggatgctatttatcaaaacaatcctttaaagccgggtgagttctataatcctattttgcagggttgctatcccgatccgagtataacgcggaaaggtaatgattattatttggtgtgctcatcttttgctatgtttcccggggtacctattttccattctaatgatttggtcaactggaaacaaatcggtcatgtgctggacagaacgtcacaattaaaggttgaagattgcggtattagtgcaggtgtatatgctcctgctataagatataatcccaataatgatacgttttatatgataaccactcaattttccggtggctttggaaatatggtggtaaagacaaagaatccggagaatggctggagtgatccgatcaaacttcaatttgaaggcattgatccttctcttttctttgatgataatggcaaggcatacgtggtacataatgatgctcctgctaaagcaaacgagcgttactcgggacaccgtgtcataaaaatatgggattatgatgtggagaatgataaagtggttccgggaacagatcggatcatagtaaacggtggcgtcaatatagaagaaaagccgatatggattgaagctcctcatatctataagaaagatggacgttattatttaatgtgtgcggaaggaggaaccggaggctggcatagcgaagtcatttttgtaagtgatcatccgaaaggaccttatctcccggcaaataataatcctattttgactcaacgttattttcctgcaaatcgagcggataaagtagactgggctggtcatgcagacttagtggagggacccgacggaaaatattatggtgtatttttaggaatacgccccaatgagaagaacagagtgaataccggacgcgaaacttttattcttccggtggactggagcggaacatttcctgttttcgagaatgggcttatccctatgaaacctacattgaagatgccttcgggagttgagaaccaaacagggaaaaacggttatttgcctagtggcaactttgtctttaaggatgatttctccgataagacattagaccttagatggatcggtcttagaggtcctcgtgaagatttcgttgagatgaccgataaagggttgcggatcatcccttttacctcaaatatcaatgaagtgaaacctacttctaccttgttctaccgtcagcagcataatcaatttacagtggcagcaaccatggagtataaaccgaaaaatgagaaagattttgccggtataacatgttatcaaaatgaaagatatcactatgttttcggtatcactaaaaaggggaaagactattacctgatactgcaaagaaccgagaaaggacaagcgagtgtcctgggtgaggtgaagatagaaacagagaaacctgtgacactgcaagtaacagccaatggagatgattatcgttttaattattcgattgatggcaagagtttcctaaatttaggaggaaccgtttccggcgatattctttctactaatgaggctggtggctttacaggagcaatgattggactgtatgcaacatctgttggttattaattagaaaccttatcattctataattatgaaaatacatcatctattttggggtatatgtttatgcttcagcaccaatatcttattcgcacagaactatcagaaaacatcgtccggtatcaaagccactgtgaatgcagtggatatagaagtacaattctttgcgcctgctgtggcgagagtaataaagtcaccggaaggtgttgcctatgaaaaacagagtctttctgtaattgccaaacctgaaaaggtaagtttcaaagctgatatacaagataataagattgtattgaacaccagtgaactaagtgtcagtgtggacaccgggacgggaattgtttcttatttctcaaaggatggcaaatcattattggcagagaaatccggtatgcagtttatcgatttcgatgatgccgggacaaaaacttatcaggtttatcaaccttttatattagataaagaggaagccatttatggtttgggacaattgcaaaatggaaagatgattcagcggaacatgactaaaaatctgatacagggaaatgttgaagatgtgtcacctttcttccagtctactaaaggatatggtgtgttttgggataactattcgccgactctttttacggataacgaagttgaaacatctttccgttctgaagtaggtgactgtgtggattattacttcatgtatgggaaaaatgccgacggtgttatagcacaggtacgcagcctgaccgggcaagcaccgatgtttcctttatggacttatggttactggcaaagtaaagaaagatataagagccaggaggaagtggtagacgttgttcgtaaatatcgtgaattgggtgttcccttggatggtattattcaggattggcaatattgggggcataactatttgtggaatgcgatggattttcagaatccgactttcaataatcctcaaaagatgattgaggatgtccatgcaatgaacgcacacatggctatatctatctggtcgtcattcggaccgatgaccaagccttatagagaattggataaaaaagggatgttgtttaacttcactacctggccgcaatcgggattggagtcatggccccccaacatggaatatccttccggtgtaagagtgtatgatgcttacaatcccgaagcgcgtgatatttattggcaatatctgaatgatggaattttcaagctgggaatggatgcctggtggatggactctaccgaacccgaccatttggactggaagccggaggatatggataccaaaacctatctgggctcgttccgtaaggtgcgcaatgcttatccgttgatgactgtcggaggggtttacgaccatcagcgtgcagtgactttggacaaacgcgtgtttattttaacccgttcgggattcttggggcagcaacgttatggtgcaaatgtatggagtggtgatgtcgcttccacatgggagagttttagaaatcagattcctgccggattaaacttttctttgtgtggtatgcctcactggaatagtgatattggtggcttttttgcaggacattataataaaagctggaatgatgatagtgcttcgaaaaatccattgtatcaggagctttatgtgcgttggttgcagtttggaacgttcaatccgatgatgcgttcgcacgggacggatgtttatagggaaatctataagttcggaaagaagggtgagcctgtatatgatgctatcgagaagatgataggtttgcgttactctctgttgccttatatttattctacttcttgggaggtgagtaatcgccaatcgagttttatgcgcgctttgatgatggattttgtagatgacagaaaggtgtgggatatcaatgacgaatatatgtttggaaaatcgatccttgtggctccgattgctcatgcacaatatacaccggaagctgtggtaaaagtctccgaagaagaaggatggaacagagatggagcgaaaaaaacaaaaactgacgctgctgtggatttcatggaaacgaaatccactaacatatacttaccggcaggaacgctatggtatgacttctggacaaacgagaaacatgaaggcggaaaggaaattaccaaagagactacactggatgttattccattgtatgtaaaagcgggtagtattattcccgtcggtccacaagttcagtatgcaactgaaaaaccgtgggatcatcttgaattgaaggtgtatgcgggtgcgaatggaaacttcattttatatgaagatgaatttgataattataattacgaaaaaggagcatatacggaaattccaatctcttggaataatgcatctcgtaaattgacgataggggcaagaaaaggtgcgtatgagggaatgttgaagaaccgtaagtttactgtaacccttcaggatgggactcaaaaaagcgtcgattataatgggaaggcaatttctgtaaggttttgattataatagaatgtgtgattaagtcagtagagaagaatctaaaaaatagaaatatgatgaaattttttatagtgatggctatgctattggctagtagcgttgcaagtgcagaaaataaacagataacaagtcctgatggaaagttggtagtaacagtcgcagatatggatggaagaccctcttattctgttagttatgacaatgttctttttttgaaaccatctccattggggatgattgcaaatataggagatttctcatcggggatgtcgctggagaagaatgtttcaacaaataaaatagatgaaacatacgagttggcttctattaaaaagagtaaggtacattatgtggcaaatgaagctgtattttcgtttacacaacaagggaaaacaatttatgatgttatattccgcataagtaataacgatgttgcttttaaatataagatgtatccgcaaggtgagacactaagttgcgtggttaagcaagaagtcacaggatttgtgtttcctgacggaaccaccactttcctttgtccgcaaagtaaaccgatgggaggatttgcccgtacttctccaagttatgagacgtcttatacggcagatgatgtcgcaggcaaaaatggctggggagaagggtatacatttccctgcctattccgtaatggagataatggttgggtacttgtttccgaaacgggagtaaatggtggatattgtgcgagccgtctgttgggacacaaaggaggagtgtataccattggatttccgcaagaaggtgaagcaaatgggaatggtacggtttctccggggatagcattaccgggcgagacgccttggcgtactattactgtgggcaagactttggctccaatagtggagacaacggttccttttgatgttgtaaaaccgctttatccggcaaaaggagagtatacgtatggacggggttcatggagctggattatcggtatggatggaagtactaattataaagagcaactccggtatattgatttttcggcagcaatggggtatcagtccgtgttggtggatgccttgtgggataaacaaataggacgtgataaaattgaagaattggctaaatatgggaaggacaaaggggtagctctttatttgtggtataattcgaatgggtattggaatgatgctccgcaaactccgagaagtatcatggataatgcgatagccagacgtaaggagatgaaatggatgcaaagcattggcattcgtggaataaaagttgactttttcggaggtgacaagcaaatgactatgcagttgtatgaggatatcttgtcggatgcaaacgagtacggccttctggttatttttcatggatgcactttgcctcgtggctgggaacgtatgtatcctaacttcgcatcgagtgaggctgtattggctagtgaaaatcttcatttctctcaaggcagctgtgataatgaggcctttaatgctaccttacatccgtttatccgtaacacggtaggtagcatggattttggaggtagtgcattgaacaaatattataatgcggataatgccccacggggaagccggcgggtgacatcagatgtctacgcactggctacggcggtgctatttcagagtccggtacagcatttcgctttggcaccgaataacctgaccgatgctccgtcgtgggcaattgattttatgaaagaggttccaacgacttgggacgaagtacgtttcattgacggttatcctggtaaatacgttattcttgcccgtcgtcatggtgacaaatggtatattgccggagtaaatgcgcagaaggaaacactgaaacttaaagttaatttgccgatgttctccaatggagaaaaggtgagactatttagtgatgataaggcattgcagggtggtgtgaaacaaatagaaatagggaagaaacaagaattacaattggctattccttgcaatggtggagtattaataaccaaataaccattttaaataaaagaatatgagaaactttaaatttttaggcgtgtcgtttttgttggcaatcactgccgctacttcaggaactgcacaaaatcctattatacaaacaaaatatactgccgatccggctccgatggtatataacgataccgttttcctttatacaacccatgatgaggatgatgccgaaggattcaaaatgttggactggttgctttatacctccactgatatggtgaattggaccgatcacggagcggtcgcttctctgaagagttttgattgggtgaaacgtgataatggtgcctgggcagaacaggtcatcgaacgtaatggcaagttttacatgtattgcccgattcacggtaatggtattggcgtattggtatccgactctccttacggtccttttaaagaccctttgaataaaccattagtttggcaaaaagagcattgggatgatattgaccctaccgtatttattgatgatgacggacaagcgtatatgtattggggcaatccgaatgtttattatgtgaaactgaatgaagatatgatttcatattcgggggaaatagccaaattggctgataaaccggaacattatcaggaaggtccgtgggtatataaacgtaacggtcattattatatggcttttgcttctacttgttgtccggaagggattggctatgctatgagcgacaaagctaccggaccatggagtacaaaaggatatattatgcgtccaacggaaagaaccagaggaaatcatcccggaattattgattataaaggcagttcttatgtgttcggcctaaattatgatttgcttcatctggagactttcgaccataaagaacgtcgttcggtatctgttgcaaaaatgcattataatccggatggaaccattaaggaagttccttattggcaggagacgaaactggaacagattgaaaactttaatccttaccgtagagtggaagccgaaacgatggcttggggatatggtctgaaagctgaaaatcataagaatggtggtttgtatataaccgatattgatgataatgaatatctgtgtgtgcgtggtgtcgactttggcaagaagggagcaaagaaattcagtgtaagcgcagcttgtgttgaaaaaggcggaatgatagaaattcgtctggacagcacggaaggtccggtaataggctgtgtcagtatatcaccaacaggaggactggatatatataaacagatgtcatgccggataaagaatgcaaagggtgtacatgatctttatttctgctttaaaggagagaaaggaaacaaacttttcaatctggattattgggaatttgaatagcttttattcaaaaaaatgagattgtaatgtgcttataatcagtgtaattatttgggtatgctacaaggggaaagatagatgtaacattgaaaatgaagatgttatttaggaaaagaagcccgtaacataattatgtttgtagttttataagctggcatatctttgcagaaaaagatcagtaattcatatttgattataaagaaaataagaggtattatgaagaatacacaggtaatacaattaatgtcaatcgtccggctctccatatttatgttggggataacaatgatgtcatgtaactcaaagaaagaacaacaattaccggctattggaaaatctgtggctctctttgattatttttcttataaaggaaatgatgatttttatatttccaatcctctgtcaggtgaagactatttctataatcctattttgccgggatggtattctgatcctagtgtttgtacaaatggagaaggtgattatttcctagtaacatctacattcacttatttccccggtgttcctatttttcacagcaaagacttggtgaattggaaacagatagggcatgtgttgaaccgtgcttcgcaattagtgaatatggaaggacagaaagtgagtggcggtatttttgctccggctatttcttataatccgtataacaagacatattatatggtaacaaccaatgtcggagccggaaatttctttgttaagacacaagacccgtttggtgaatggtcggaacccgtcatgttgccggaggtcggaggtattgatccttctttcttttttgatgaagatggtaaggcatatattgttaataatgatgaggctccggataataaacctgaatatagcggccaccgtactatacgcatacaagagtttgatgtgaaaacagataagacgatcggtcctcgtaagattcttgtaaacaaaggagctcaaccggcagacaaaccaatttggatagaaggtcctcatttatataaaataaatggaaagtatttcttgatgtccgccgaaggtggaacgggtaactggcattcggaagtgattttccgtggtgattctccgatgggtaaatttcttccatggaaaaacaatccgattctgacgcaaagacatttgaattctgaccgtcctaattcggtaacctgtgctggtcatgcagacttgattcaaacaaaagagggagattggtgggctgtttttctggcttgtcgccctattaataatcagtttgagaatttgggacgtgaaacatttatgatgccggtgaaatggagtgaagatggattcccgtacatgacacaaggagatgatttagtacctatgattgtaaaacgtgaaggtgcgaaacgcgatacgatagttacttatggtaacttcgagttaatagagaactttgattctcctgtacttgatatgacttggatgactttgagagcttctgcttccgatttatattcattgacggaaacacccggatacctgaccttgaagtgtgcagatattagctctacggaaaagaaaactccggcatttgtctgccgtcggttacaacatcataaatttgaatgtgctacccgtatgttgttcaatccttctaacgataaggaaacagccggaatgttattgtttaaagatgaggcgcatcaatatttcttctgcttgaataaagtgggtgagaataaaaatatttctctgaaacaaatcggtgaaaaggaacagacattggcttcagatgaaatagacgcagatacaaatgaggtatatttgaaattagtatctcaaggaattggttacgacttctattattctattgatggtgaaaaaagctggaaactgctttgtaaagatgtagattccagttatctctctactacaacggctggtggatttaccggtactacaattggattatacgctacttgcaaataattattttttttatataaatctaatactagcaactatgggtgatatttataatgatagctaatgcaattaaaaaagaatgatgattagaaaacaatgtagttaattaacatcttaaactaatggtaatgaaaaatgtaacgaagaaaattcaaaaaattccttacctgtttctccttatgttgtttagttttgtaacagcatcagcacagaaagggataacggtgaggggaacggttcttgacagtaatggtgagacaatcattggagcctcagtaactttaaaaggtaatagttcaataggtacaatcacagatatagatggcaattttgtattgactgtgcccggtgagaagtctgtccttattgtttcgtatgtaggaatgaaaccgcaggaagtaaaagtggtttctaaaggtcttattaaagtaacattggaagatgacaccaagcaactggaagaagtggttgtggtgggttacggacaacaaaagaaagcgtctgtggtaggtgctattgcacaaaccactggtgagacattacagcgtgcaggtggtgtgtcgaatgtgggtgcggcattgacgggtaatttgccgggtgtggtgacttctgcctctactggtatgccgggtgacgaagacccgaaaattgtaattcgtagcgttagctcgtggaataatagcgaaccgcttatccttgtggacggtatcgaacgtccgatgagcagtgtggacatgagttctgtacagtctatatctgtattgaaggatgcgtcggcaactgctgtttatggtgtgaagggtgccaatggtgtcattcttgtaaccactaagcgcggtaacgaaggtcgggccaagattgacgtaagtatgaacatgacggctaaagtggtttctgctctgccgggaagaatggagtcggcggatgcgttgtatgtgcgtaatcaggctgccgaatatgagttaggcttgaatcctgcttcttggaataaaatattgccgatggagacgattgacaaatatcgccatcctgctaatttggaagaggccgaacgttatccgaacgttgactggcagaaagagcttttcaaagattatgccatgtcatacaatccgagcatcaacctgtcgggtggtacacgccacgtcaaatatttcgctgcggtagactttctgcatgaaggtgacttgttccgcgaatgggacaataaccgtggttatcaggcaggttacggattcaaccgtattaatgcacgtagtaatttggacttcaagattaccaaaactaccgtattgaaagccaatattttcggttcttacggtgtgaagaaatcaccgtggggagttgccgacgattcatttggtgcctcgcagttgtggcaggctgcctacagttctccgtcagacgctttcttgccccgttattccgacggtacgtggggatactacaagcccaattcgcaaggtgcgccgaactctgtgttgaatctcgccaatgcaggctatgaaatgcttactactacccgcgtcaatactgactttgtattggaacaggatttgagtttcctcgtaaaaggattacgtgcaagtgccatgatttcgtgggacaacgtgtttgtggaagccggtcgtggtgtcaatgacttgaatcacgggacgcagaccaaatggatagatccggaaacaggcgaggtgcattatagcaacgcgcaaaccgactctaaaaccggactcgattttcaggaaggtatcttgtggtctacagcaggtggtgctgtgcgggactggtctactcaacgcaatcttttttatcaaggacaattgtcatggagcggcaagttcggtgaccacgatgtcagcgccatgggagtgttcaaccgtaccgaacgaagcactggtagcgaattccctcactatcgtgaagactgggcgttccgcgccacttatagttatggcaaccgttatttcttggaatacaacggtgcatacaacggttccgagaagtttagtcccgactatcgtttcgagttgtttaactcaggtgcgttgggctggatgataagcgaagaaagattcttcaagcctctccgtaagtgggtagatatgttgaaagtacgttattctatcggtgaggtaggtgacgataatcttggtattcgttttctatatgctacacagtgggcttacggaggtaagtctttccacggtttgaacaatcgaaccgagtctccttacacttggtacaaggaagctacggtaggtaatcccgatgtacattgggaaacagctttgaagcagaatatcggtgttgattacgctttcttcgatggtttgcttgccggtagtttggaatttttctatgacaagcgttcggacattcttgtagccggcgacaaacgtgccactcccggttatttaggaatttccgccccggctgccaacttaggacgcgtgcgtacgaaaggatacgaattggaacttcgtgtaaataaaacattgaacaacggtcttcgtctgtggggtaacttcaatatgactcatgctgaaaacaagattctcaaatacgatgaccctgtgttgcgtcccgcataccagaagtcggaaggatttgccatcggacaagaccacgctcatcttacggcaggatttgccaacacgtgggacgaagtattcgccatgcctacacacaatacgatgaacgatcagaaattgcccggacagtatatcactatggactataatggtgatggcgtgatagatgccaacgacagcgctccttacggctatacgggtactcccgaaaatacgtacaacgctactatcggattcgattacaagggattcagctgctttgtacagttctatggagtgaccaacgtcaaccgttatgtgggttttacttccttgcacaataacgtgaatactgtattcgacgaaggagtattctggtcgaaagatcgttttgatgcagatgctcccatgcctcgtatcaattctactccgagttattatgaaggtactcgcttccattacgacggttcgtttattcgtctgaagaatgctgaagtggcttacacttttacacaaccttgggtaaagaaaattggattgaacagatttaaaatattcctgaacggaaacaacctttgggtatggtcgcgtatgccggatgaccgcgaatcgaactttgcaggtacgggattggcttcgcaaggtgcttatcctactgtacgtcgtttcaatctgggtattaaatttgacctttaaaacatcatcgaattatgaaaaaatacattataaaatatgctgtaatggcttgtttgagtctcggattgacgggtacgactgcttcgtgtaccgactatctggacaaggcacccgaatcggatgtcactccggaaaatgcctttaaggacttccacaattttcagggatttgtagaagagctttatgcttgtattcccgacatggccaaacaatactggtcaaactcttggaactggggtgaagacgaagtgattggtgtagactgcaattatcacatgggctataaagtggaccaaggcgacttttgggggtggcaggctgaacacgacggctggggggccggatttatggattgcaaaactctgaatctggactttactactccgaacgacggattcagatggaaccgcgacttgtggcccgcttcttggtacggaatccgtaaatgtaatacgggattagcaaatctggacctgcttaccgatgcaacgcaggaacagaagaacgccattgccggacagctttatttcttccgcgggtggtttcatttcatgctgatacaatatttcggcggattgccttatatagataaggtgttgcctcccaacgaaacattcaacgagccgcgactcagctatcacgaatgtgccgacaaggctgccgatgatttccggatggctgccgatctgctgcctattgattgggacaagacatctatcagcccgagcacgaaaggatacaaccaactgcgcatcaacaaaatcatggcactgggctatttaggtaaaaactacttgtgggcaggaagtccgttgatgaacaaggtgtccacaggaagtgaatcctacaatcaggaatattgccggaaggctgccgaagcgttcggggagttgcttacgctggtagagaaccgacagacgcaatatagcttggtggactttgaggactattccgacctcttctacacatacggaaagaatgcccaaatgccgggttctacagaagcattgttcagaggattggtggcagatggctggcaaaactcaacttttggtttagctcttcagtttgtgcctgccagctataagaaagataacaatccgcaactctcgcccacagccaactatgtacactattacggtatggcaaatggattgccgctcgacgaccaggaatccaagtgggacaagactcatccttggaaaggacgcgacccacgtttctatcatgatattcgcttcgacggttcgcctatggtatctgatgcaaaaaaagattcggaggaggtcggtgacttagccgttgcatccctctacacaggcggaaacgcccgtgacgaccagttcggaagccgtaccggattcctgcttggcaagtttattccggtgacagccaataaatgggatgatggctggggatggagtccgcagatgcatatctattgcagctatatgcgtctggcagacatttatctgatgtatgctgaagctgcggcaaatgctaccggctcgtctacaggaaagtcaaccaactgtacacttacggcactggccgcagtcaacaccatccgcaaacgtgcgagagtagaaggtgtcaatgccaaatataccggttcaatcgatctgttcaacagtgagattcgccgcgaacgtgcggtagaacttgcatacgaaggacaccgtttcactgacttgcgtcgctggttgcttatcgacaagaaaccttataccgaaaagactgctgtcgatttccaacgggtaggcgaccttgccgagaaccctcaggaaacagctgtaagcggctatacatatcgggtaatcgtgacgcgtaatttcacggagaagcattactggttgcctctgaaattgtctgacgtgaccttgtatccggagttctatcagaatccgggatggtaaacaagtgacttattaaacgaaatagaatatcatgaaacaaattcataaaaatataattcttagcgccggactattgtttgcttctgccgggctgatggctcagacggatgtggagaagactgatacattggctcagaaagtgaatgtggctttccgcacagtggaccgggcggatttgatgggtggtgtctcgtccgtcaatgtagaggaactgactaataaaagttattcgctgtacagtctcgacaatatgcaatctttagtgggaggttacaacggacaattatggaacatgggcgaagcgttggtattggtagacggagtccctcgtgaggcaaacaacattcgtcctaccgaaatagcccaaatcacattcctcaaagcagcgcaagccgtggtgctttacggcagccgtggtgcgaagggagtcattcttatcaccacgaagcgcggatgcgataaagacttgcgggtgagtgcgcgtgccaatgccggtatcaatgtgcctaaaagctatcctaaatatctggcttctgccgaatacatgacgttgtataacgaggcgttgcgtaacgacgggttggatcccgctttctcggatgagcagatttacaactatgcaagcggaagtaacccttaccgttatccgaacatcaacttcttttccgatgactatattcggaagacaagtcaggactataacggagtggccgagtttttgggcggcggacgctacgccaacttctatacgaacatcggttacgagagttccaacgacttgctcaacttcggtgaaagtaagaacaaccgcaattcgcgcctgaatatccgcggtaatgtggatttgcgtatgaacgattggatcagcggttgggtaaatgcaaatgctatcttctacgattcccgtcacgataaggcagactactgggctaactcggctacgttacgtccgactgctcccggttcggcgcctcttgtacctttcattcccattgagtttgtcgataaaaacgatgctgcttcgtggacgttgatcaataatagcaattaccttattgacggcaaatatctattgggaggtacgcagttgaacatgactaatccttttgctgccatgtatgcgtccggttatcagaaagctacttcacgtcgtttccagtttgatgcgggaatcaacctcgatttgtataaagtactgaaaggattgtcattccgtacacagttctccgtagactacggaacttcttacatcacttctatcgacgacgactatgcagtgtatgaagcctcttggaacaatgctttcggaggcgaccgtattacttcattgactaagtacaatatggacaagcataccggtacgcaaaacgtatcgggcagtacggcgtatcagaccatttatttctctgcacagttcggctatcagaacacttttgccgacaatcatcatgtgaatgcattgttgttggctcaaggcagccagcagacctattcgggtacctaccatcgcactagcaattccaacttgggtttgcaactcgattataactatgccggtaagtattacgccgatttcagcatggcagcggttcattccgccaaattgcccgaaggcaaccggatagggctttcgccttcgtttacgttgggatggcgtctttccgaagagggtttcctcaaagatgccgattggctcgataacctgaaactgatggcaggctatagtgtgctcaatcaggatttggatatcagtgattactacatgtatgctaccaagtttacacaggcaggtacgtggtggggatggagcgaggtaaacaactcgatgcagaccaccgacttcctgcaaggtggaaaccccgacctcggctacatcaagcgtaaggaatttacggtaggattggacgcttctctttggaagggattggtgagactcaatgccaattacttcgtaaccaataccgaaggattgctggcgcagccccaaaattatccgtcttatttccagacttattatccgaagtccgatatgcgtccttatattaacatgaacaaccaacgtcgtacgggtgtggacttgagtgtaaatgtgggcaaaaagcacggtgactttgaatggaatgtggggcttgtgggtatgtactacacctccaagaacaccaaatgggacgagaatgtgaaatatgactggctgaaagccgaaggtgaggcgattgatgctttgcgcggatatcaatgcatcggattcttcaaagacgctgccgatgtggaaagctcggcaaaggtgaatgctaataccaaacccggtgatttgaagtatgtagaccaaaacaacgatggtgtcatcaatgagcaagaccaggtggtattgggcaagtggggtgcttcctgggtgatgggtctcaacctgactgccaagtacaaaggcttcacattgtttgtggcaggcaccggatcgtttggtggcaaaggactgaagaataatagttatatgcacgtgtatggcgatcgcaaatattctgaagtggttcgcggacgctggacggaagagacggcagatatcgccacatacccgcgtctcacaacacaaggtggcgacctgaactttgtggcttccgacttctggttgtacgacacttcacgtttcgatttgaaccgtgttcaattgtcttacgacttcccggctgctatgctgaaaggcaaacttgtgaaaggtttacaaatctatgccaacggaacaagcctgttgaccttggcgaaggagcgtaaatatatggagatgaatgtagggacttctccccaatgccgttcgtacgcactgggtgtaaaggtagacttttgatgggtctctcgttgtagaatataaaaatatagaataaataagtcatgaagaaaattataacaatatgtgcctttgccgcttgtctgaccggatgcgatgacttgttcgaaccggctatcgagaacaacctcggactggaatatatgtacgagaattcgcaatatgccgaaggaatactggcaaatgcctatacacgcataccctgcgcaggctattctttcaacgacgtggctaccgatgacgctgtgagcaatgatgcggaaaacagctggcgtaaaatagcctccggcatgtggacggcaaacaacaatcctgccgaccgttggacttcctgccgttccgccatacagtatatcaatcttttccttgccaatgccgacaaggtgaaatgggcgaaagacgaagtggtggcgcagatgttctgcgaccgtgagaaagcggaagcctatggcttgcgtgccatgtatatgtattacctcctcgaagcccatgcgggctataccgaagacggtgtgttgatgggggtgcccatcctgaccgaaccggaagcagccggatccaatttcaatgtgccccgcagcacatttgtagattgcatgaaggcgttgaaagaagacgcccggttggcactcgaaggattgccttgggaatatggtgacgcagcggaaatgcaacgcttgtctgctaaatatgcaggagcagaccaaggcaaagtcacccgtgtgtttggcgcaaactttatcggccgtatgtctggaaaggtggtggaagcgtttgtggcaaaagcggatttgcttgctgccagtccggcatatagtgaccagtcaggcgttgattggaaaacggctgctgctagtgctgcaaaggtactgaatcatatcggaggggtagacggtatggatcctaccggatggacatggtattgcaatgtagatgatattgaaaaacttagcccaaccgaatcacctgctgaaattctgtggcgtggtgaacgtgccaaatccctctcgctcgaagaagataacttcccgcccacactctacggtaacggacgtatcaacccaactcaaaatctggtggatgcattcccgatgctgaacggttatccggtgtctcatctgtccggcgaatatgatgaaaatcttccgtatgccaaccgtgacccgcgcttggaagcatacattctctataatggttgtaaggcaggcaatacgaataaggaaatctttacggcagccgacggaactaccaatgatgcactgaacaaggtggtaggacgttctacccgtaccggatactatctgcgcaaactgttgcgtcaggacatcagcctcgacccgaatgcgaaagccgaccagtatcattacacaccgcgcatccgctataccgagatattcttggcgtatgccgaggcggcaaatcaggcgtacggtccgcaagataaaggaggcaacggctattctgcttatgatgtggtgaaaaagttgcgccaccgtgccggcatcggtcgcgacaatggtgatgcttacttggaatccatcaagaacgatcaggcaaagatggcggaactcatccgcaacgaacgtcgcatcgaactttgtttcgaaggtttccgtttctgggatttgcgccgctggaagagcaatctgaccgaaaccgctaaagggatgaatatcagtggaacccgttatactccaatggaggtagacaaacgctcgttcagtgagtatatgtattacggtcctattccttattcggaagttcttaagtatgacgaactgaaacagaatcagggttggtaaaccgatagtgtaaatttaataaaatgctaaagcatacaatgattatgaataagacaataatgaaatgcatggtccttggcttgttgtttgccggctgtgaaaacggagacaaagaattcgacgattacgaatatcagaccatcagttttgctactcagactcctatacgcaccatcacattgggcgaagatgtatatcctaccgaacaagacaatgaatatcggatgcagatcatcgctacattgggcggtgtgtggtcaaaccgcaaagagcgcacagcacagattgttatcgatgaaagtttgtgtaccaatgcttatttcgacaatggcaagccgatacttcctatgcctaaggaatattatacttattcttcggaacaggtggtatttcccaaaggagacatttatggacgtatggacatacagttgaccgatgctttcttcaatgatcttctcacgcccgaactcacctatgtcattccggtacggttagcacaggcttcagactctatcttggcgggcaaacctaaagttgagtctcccaatcgcttgaatgtggcagactgggacgtgcttcccaaagactatgcgctttatggggtgacctacaaaaacaagtatgagggcgtttggttgagtcgtggcacagaccagctcgacatcaatggcaacacttctacgctcaaccgtaacccgcagaatatagagaaagcagaccaacgtacattgggaactattgccctcaacaaagtgcgttatcctctttcgctttcggtggatgtggtgaatgagaaaggcgaatcttccaagcaaacgttgacaatggacttggtgataacggttgacgacaacggcaattgctccatcactaccgacacaccgggggctcaggcaagcggttcgggcaagtggacctatcatggtgccaagaaagcgtggggcgacaaagaccgcgacctgttcgaactgacctatgaagtgacttatgcgccttatgtgttgaatgctgtgaccggtgaaacgggcactgccaaatgtagcagcacggacgcgctggtgtcacgcgacagacagagcaaatttgaaacttttaacgtgaagttgaagtgaaccgcaatctaaacaatttaagaaaactacatgaagatgaatagaaaaaataatatggtatggggcacgctggtagcagctttgctggcttcttgcgtggataccgagattgccgatgtcacggtgacaaaaccggagtcgatagcgcaatacgagtatctgaatgattatgccccgctgaaatcgtacatagaccgtgcagctaatcccgattttaaattgggattagcgttggcagccaacgaatttatcgaaggaggattggtatttcgtttagcggaagccaacttcgacgaagtgaccgcaggcaatgcgatgaaatatgcttcgtgtgtgaacgataaaggggagatgaatttcgaaactgtggataaatttgtcactgccgcccaagctgccggaattactatatatggacatacattggcttggcatgcacagcagaataataagtatttgaattctttgattaaagacaaagaattgccgccctctgtaggagaaggaaattgtttgcatatcaatacttctgaagcgaaggcgaatccatgggattggcaaaattactatgatttggaatctcctcttttacaagggaaatcttatgtattctctatgagaaccaaggcttcatcagctgtgacatttccgctttggatagaaacaccgaatgctggtaatacacattatggcataccacagatttcagcaggaactacatggagcacaataagcattgaatttacacctaatagtgattgttctcgtttgttattcaatttcggacagtttggaggagatctttggtttgatgacatggtgctggttgaaaaaggttctgagcaaaatatgataaagaacggaacttttgaagaaggaaatctgccttctaattggtctaaaccaagttggcatgcgcattcttattcaattatacctacaccgggagatgcggcagtagagattttaactgacatcattactaatggtgatgcgcaaggcagtgaaactaccaattttgtttctactcatgtgggaggagctaatgctgcttgcgatattgttgatggagtaggtaaagacggtagtcgtgctttcgttgttacttctgctggtggaggaacaaacagttgggatactcaattctttttgtatgctgaccgtccgttggtggaaaatgatgttgtacgtatctctttcgattatcgtgcagatacacccaataattctgagtctcaggctcatgctgcccctggagcttatattcataatgatggtgggtgtgctgttagtttcactacggaatggcaacactttgaaaaaactattactattaacactaccctttctcctgagggaaacatgcagacttttgcatggaacttggatgtaggcgcgcccaatgcacctgctaataaatattattttgataatatcaaattgcaaatagttactaaaggtaacactattcctcttactcccgaagagaaaaaagaagcgcttactcgggcaatgaacaattggattgaaggaatgatgaaagctactggtggttacgtgactacttgggatgtagtgaacgaagctatttcaggtggtggcaacgacggtgaaggtttctatgtcttgcaatctgcatctaatgccggtgctgacgctgccaataatttctactggcaagattacttgggtagtgaagattatgttcgtattgttgtagctgccgcccgtaaatattatgcagaaaacggtggtgttaaacctctcaaacttttcatcaacgattacaatctggaatccacttgggataacaatcagaaagccaagagcttggtacactggatagagaagtgggaatctgacggtgtgacaaagattgacggtatcggtacacagatgcacgtggcttatcgcgccaatgctgctgaccagcagaagcaagaagaacatgtagtgaaaatgtttgaaatcttagccaagagtggcaaactcgtgaaagtatctgagctggatatgggatatgtggatgaaagcggcactacggtgttgacaaaggatatgacagaagaacaacataaagcgatggctgaatattataagtttatcgtgaagaaatacttcgagattattcctgtggcacagcaatacggcatcacgcagtggtgtgctaccgatgctcccggtgcccccggtgattctaactggcgtggcggtgaacctgtaggtttatgggattccaactacaaccgtaagcatacttatgccggttttgctgacggattggctggtaaataatagagattgataagaaaaggcagcggggcatataacatgaatccgctgcctttattgtttcaataaaagtcggataataatgaaaaacatattatttattttaagtttgattatttggtgtagctgtagtaatgaaattctgtttgatatagataaagtaggagatatagttacaagggctgcaaattcggatagtacatattgttttggggcttcagattcggatgtagtggaggactttgttattggtccgaaggatgactcacaacctcttagtagaactttatgttcctatgtagaggttaatggaacaaaaacattattgcaacctgaaatagtgagcgatccttcatggttggattatcttatatgttttcagtattatgatatatatgttctatcggtagtagcccaggacaatacttcctctctcagaagtggaaaaattgtattgaaacagccgggatctaataaaacattaacagttggtattactcaaaatggaattgataatcgcataatgatttcaatgaaagaactgtattccaatcatcctatttttactgccacgacaacttatcccgtaaaaaaagatataagttgcagaatcccatacgaagcatacaatgatggtggaaagtatgagagtagtgcatcaatcactattcctaaaggggaaacgaaaggaacttacgaaatggattataacggctctccgttagttttttatcatggtgatataaaaggctataaattgtatgaaggaactatcagtggtgacggtatttacaactatagtttttatcgctattggtagtattgttatttttgcaacaactattatgtaacatcaacatcattatgaaaaagataatttatttgctggcatggataggtgtggctttggcatcttgttcggacgaaagctctctgcctatacaaccggagattcctgccgaaccggaaacgcctaaggacgaacctgctccggagaaagactatcatcagttgccagtgttgcacgtagaggggcgctaccttaaaaacgaaaagggcgagacggtcaatcttcatggatttacacagacctacagtcccttttttaacaacaacgcatggactaactacgatgtgcagtcgtgtcttagctataacaaacgtatggtagacgggattgtggctgccggatggaagttcaacttcgtgcggatgcatctcgacccttattggagcgatgatacttcaaagccgtttgtgcgatacgaaggacacgaacgcttttccgagacccgtttccgcaagtatctcgacgaactgtttgtgccgatggcggagtattttgtatctaagggaatgtatgtggtgatgcgcccgcccggggtatgccccaacgaagctccttatcagggaatagaggtgggcgatagctatcaacagtttctgcttaacgtgtgggacatcgtttcgcaacaccccaaagtgaagaacaatacggacatcatgttcgaactagccaatgagccggtcaacatcaaagggaccgacggagcctatggcagcacctccgatgcctgctttgccaatgcaaagatttacttccagtccattgtagacaagataaggagccattgccgtaatatcatttgggtgccaggcttggcctaccagtcgcagtatgccgggtatgccacccaccgcatcgagggcgataacatcggctttgccgtgcactgctatcccggatggtatggcagcgatgccgaaaaagacagtggcgaaggaatcggctcttctaccggtggcggctacgagtccttccagcgcggatgggataagcaagtaggtccggtggcggcgattgcccccatcatggtgacggaaatagattgggcacctttgaaatacgatgctacttggggaaaaagcatcacaggcgaagccggtggcaaggggttcggcgccaacttcaagtatatagccgacaatgcgggaaatgtgtcgtggctctttttcactacaagaagccacgagctggcagcgtttaaggacgtgccgggtacagagggcaactatacgttcctcaacgatcccgaagcctgtccgtgggcaatgtatcattggttcaaggagtatgccgaaggagtgaccgtcaatggcgagcccgagagactggaactgatgggcgagcaggcgacacgctcgttgcagatgggaggagtgcactacctgaaagtgaaggcggtgtataaagatggcacctcgcgaatggtgactgccgaggcgactatcaatagttcggacgaacaagtgctgaaggtggagccgactggcaaactggtggcagtggcaccaggcaatgctacggtaacggtgacttatcgcacagcagcgggaaacagcatgcaacagacattgcaggtgacggtggtttcgccttttgtgctgacggaagacgtgtttgacccttcgatatgggaagaaggcacctttgacgaaacgacccgcaccttggtgacaggcaaatatggctttggcggatggaaataccccggcggacttgacttgtcgggctaccggaggctgaccgtggaattgggcaacgacaacgagtgcggtgtctctttccgcctttttgacaagaacgactactggacgaagcccgccacctacgatttcggacagacacgcagagtggtggtagatttgcagcagatgaaagatactgacggcaatagggtagacccgtcgcacctctacattgtcgggttctggtcgactggtggcaagccgattgtgataagcagcatgaagttggaataaatataatatagaaagatagtaaatgaagaaggttttattgttgagttgtttgttgtgtgcaagcctttgcgcggttgcacaggatgcaaacttttacatttatctgtgtctggggcagtctaacatggaaggcaatgcccgctatgaagcacaagatacgctggtggatgcacgcttccaagtgttggcggcggtagacaataaagagttgggacgcgtgaaaggcgaatggtatcccgcccgcgctccgctgtgccgtccgaacaccgggctgacaccggctgattatttcggacggaccttggtagaaaacttgcccccgcatgtgcgcatcggagtggtgcacgtggcgataggcgggtgccggatcgagcttttccagaaagacaaatgcgaggagtatatcaaaacagctcccgactggatggtgaatacgctgaaagagtatgacaacgacccgtatacccatttggtggagatggcacgcattgcacagaaaagcggtgtgataaaagggatacttctacatcagggcgagtcgaacaccggtgacaaggagtggccccaaaaggtgaagagcgtatacgacaacctgcttgctgaccttcatctgcaggctgacgaggtgcccctgattgccggtgaagtggtgaatgccgaccacggtggtgtttgtgcaggcatgaacgaggtaattgctatgttgccgcaggtgataaagaactgcgctattgtctcctccaaggggttgagctgtgctcccgaccatcttcacttcgatgctgccggttaccgggtgctgggacgccgctatgcggcacaggcactccacctgatgggcattgaacttccttcgcccgatgatgtgtgtaagcacacagtggcagcccccaccaatatgcacggcagcgacttccctcgtatcgacaaggacaaccgtgcttatttccgttgctacgctcccgatgtgaaacgcttgcaggcagacgtctgcggcaagaagtatgagatggccatggacgagcacggctggtggagcgtgaagaccgacccgctgccggtgggattccactattatttcctgttggtagacggattcagggtggtagatccctcttcgtgcaccttcttcggttgttgccgcatggcgagcggcatcgagatacccgaaggggcagagggcgattactatcgcccgcagcaagtgtcgcatgggcaagtgcgctcctgcacctattattcggaagcgaagaaagagtttcgtcgttgcatggtgtacacaccggcagagtatgagtctcacccccaaaaacgctatccggtgctctacttgcagcacggcatgggagaagatgaaaccggctggagcacgcagggaaagatgaatcatattatggacaacctgattgcatccggtcagtgtgtgccgatgctcgtggtgatggatagcggtgatgtggaagctccgttccggccgcgtccgggaaaagatgtgaacgaggagcgggctttgtatggcgccaccttttatgacgttattctgaaagacctgattcctatgatagaccggacattccgtacgaaaaccgaccgcgaacaccgtgctatggcaggactctcgtggggaggacatcagactttcaatacggttctgcctcatctcgataagttttcttatatcggaagtttcagcggggcgattttcggtctggatatgaagacttgttttaacggagtgtttgcggatgcggacaagttcaataagaaagtgaattatttctttctcggctgtggcacggaggaacaaatgggaacaaagaagatggtggattcactccggaaactgggtatcgaggttgattattacgaatcgcaaggcacagcgcatgaatggctcacgtggagacgttgcctgaaagaatttgtaccacatttatttaaacactgaaaatagcatgaaaatgaaatctacatttatcgcagccatattgttgctcgtttcggttatgaccgaaggaggactgtcggcacagaacccgattgtacaaacttgctatacttcagaccctgctcctatggtgcatgatggcacattgtatgtctatacgggacatgatgaagataaggctgattttttctggatgcaggaatggcgcgtgtattctaccaaagatatggtgaactggaccgatcacggttctcctcttgccatcgaatcattcgactgggcggacgaccgtgcctgggcagcacagtgcatcgaacgtaatggtaagttttattggtatgtctgcctgcattccaaactttccaatacgatggcaatcggtgtggcggtaggcgattcgcctgtcggtccttttaaagatgccatcggcaaaccgcttcatgacggaagctgggactatattgatcctacggtcttcattgatgatgacggtcgtgcttatctgtattggggaaatccgaatatctattatgcagaactgaatgacgacatgatttccttgaaaggtgaagtgggcaaactggaacagactgttgagagctttggtgcacccaatccggaaaagcgtgtcaaaggtgttaagtataaagatacttatacagaaggtccatggcttcataaacgggaaggaaaatactatcttctttatgctgccggaggtgtacccgaacatattgcctattccatgagtgacggacctcttggtccgtggaagtatatgggagaaatcatgcctttacaagatacgggttcgtttactaaccattgtggagtgatagactataaaggcaattcttatttcttctatcatacgggtaagctgccgggtggtggaggcttcgggcgaagtgcggcggtggagcaatttaagtataatgctgacggtactttcccgattattaatgctacccgggaaggggtgtcaccggtaggtatgctcaatccttacgaaagggtggaagctgaaactattgcgttttctgaaggtgtgaagtctgaacccaaagcgaaaaccggtatatatatatctgaaattcataatggagattatataaaggtacgtgaagtggatttcggcaaaaaatcccccaaatggtttactgctaccgttgccagtgcccttcgtggcgggacacttgaagtacgtacagacagtataagcggaccattaattgcggaactgactattccttcaacgggaggttgggaatgctggaaaacattgcagactgatattgtaaaaccggtcacaggaatacaagatatttattttgtattcaaaggacgtaaaggctgcaaactgtttaactttgattggtacaagtttaacagataaacatgctagagagcagttgggttactcttcttttttactcaactgctctttcatatacattgaaggcggcattccatacaattctttgaatgttgtcgagaaattattaggatcagtgaatcctgttaacatggctatctcggatatggtatgctgcttttcggacaatagacgagcggcttcttttaaacgtatattacgtataaagtcacgggttgtctggttggtgagctccttgagtttcctgtgaagatgtacgcggctgatacctacctcggtggtgattgtctctattgtcaagttagggttactgatgttttcattgatcactttcataatacgttccatcaatttctcatcgggtgatttcacttccagtttctgaaccttgttttccagattttgctggcctgtaaatactttgcgtaactgctgccgtgtattaatcagattttctaccgtcttttgcagaatttcgatattgaatggcttcatgatataggcgtcggctcctgtattcagaccttcaaggttgtcttcttccctcgttttcgcagtaagcaaaatgactgggatatggttgagatttacattctgcttgatcttccggcataaggtaagtccgtccatttcgggcatcatgatgtcactaatgactaaatccggagcctttttaaatgtttgctctaatgcttctttaccattacggctttccatgatatgaaatttgtccccaaactccttcgctatataatttcggatttcttcatcgtcttctacaattaatacgcgatatttagtttttaccctgactttcttttcttcctcattttctataatgggagagatgacaggaacagttggtacggctactgttaccttttgctcattgttgtcaacttcttcaggtcgtagatgcttgttacccaacggtaatcggataataaaacggcaacccggttgttctttattattttctacatagataattccatgatgtaattccactaatgaacgagtcagatgtaatcctattcctgttccgcctttcggattctgttggctgttacggatctgatagaaacgttcgaagatatgttctttttcctgttcatcgatgcctgttccggtatccgcgataattatttcggcatattgtttcaagggatcgggcagtgtattatcttctcccgtacggatggtaatatctatgtttcctttttcaggagtaaacttgaaggcattagacagaatattcaggataattttatcaaaattacttgtgtctacccatacattcagttcccggagtgtactatgaagttgtagttggatatttttagtatttgcctgttggccgaaagttgtacataaatcctctataaaaggaataatattggtctcccggaacatcaggaacatttgccctttatcaattttccgaatatccattagttgattgacaagattcagaatacgttccgcatttctgtagataatatgatatattttcaggcgttcattgttctcctcattcttaatcagtttctgtagagggctgatgattagagacatcggagtgcgtatttcatgagagatgttgataaagaactgcaattttgcttcattgatttgttcggcatggatatgttgcagcatttcctgatgcattctgtaccgatgtctgatctgaagaataatgataaatataatggtcagtaataataaggagtagataactttggcccaccatgaagcataccatgcaggagatataaagatggtaatttcttttatatttgaatacacagtgttgtcttttgctctgattttaaagttataggtaccgggtttcagattgctgaatgagatacggtttacacctttgggcaaactaatccatttttcatcgttgatagaataaaggtagttgatgtgttcgggggcatttaattccagagtggcaaactcgatactgaacacattgtctttatgggatagataaaactcttttgcgttgaatacagggcagttgataatattgtgaataccggatttcattcctattctaaccggattgttatgcaggaaaaagtcggtaatccggatattccatgtttttgccggattgataatgtcttgcggattgaaataggtgataccattcattccgccaaaccagatggtgccttgctcatctttgaatgaggcatttttatagaactcattcccttgtaatccgtcacctacataataattgatgaatttgttatttttcttttggaattgggatactcctgcgttgctacttatccataggaaatcattctcgtctccttgtattgcatatattgtattgctgggcaatccatccgcggtggtataggtcgttatttctttggtctccttattccaacttgacagcccttcggaacttccaagccatataattccatggttgtcttcataaattgaataaatcacgtgttggggtagtatcttatagctctgaaaatcagaggtgtcaaggtcaatgcagttcattccgtcgtaagttcctacatatagcttgttgtcattggagtagtgcaggcaacctatccattcatttatcaatgaagaattggattgcacagaagtaaactccttggttttaagatcataataaaacagcccgaatcccattgtcgcaatccaaagacgcttgtttttatcttctgcgaaatcatatacacgttgtatatagttgttgttcttatctaccagtttgtactggtaatcgcataatcctgtctgtttgttcagctttcccataccgttaataaaggagccgacccaaatgttgtactcggaatcttcatatagttttataactgttgaaggcacagaattagggtgattagtatgcgagaaatgtttagccggttctaacttttctgtcagggcataaattccgtcattgtctgttccaacccataacataccgttgttgtctttgcagaatgaggttatacaactggaaccgatcatgtttttatccatggatttatgtcctatatacttgaaactgtttgttcgggcaggtatctgcatgactcctttctgataaacagccaaccataagttaccggaattgtcttttaggatagaatgtatttttgaattttttgaatcaaaatagttgttgtcaaaattgtattcggagatttcatgagtttggttattgtagacactcatacctttaccatcagttccgatatataattcattttgcggtccggaatagaggaagcaaacaggaagttctcctttctctttcaaatcgaccggaacaaaggttttacgttctttatcgtaaatgaatagtccttttcgtatacttcctacataaatgttgcctcgttgatcctcacatatacttttgacgtatccgttgtctttagacaagtgtaacgtaagctgattgtcgggagtgagttgatatactccttcttccccttttgccatccatacattttgttttttatcttcaaacaggcttccgggtgaagtgactgcaatatcgactttccggacagtcaacagatggtctttgatgtccagcttgcacaacacatttccggatacccatatctctccgttttttcgctcgatgaaagaattgatgttgctttcaagcgtttctccggtatcttccaatttggcaagtggagtaaaattgtccgtggccggatcatacatttgaattcctatatatgtgccgataagcaaatgacctttgctgtcttcaaaaacagtacgaacaaaattgtgggctaacgaatgttcattattgggttcatgtttgtatatggtaaatttagcaccgtcataacggttcagaccatcttctgttgcaatccaaatgaagccgttccggtcttgatatatttgattaatcagactactggagagttctttgtcagtagtgaataacttaggagattgtccgttgcataacaaagaaaacaataataatagaaaagtgaatacatttttcatagttatagatcgttgtttgttgtacaaagaaaactaaaaacctaaatataacctaataaaaaatgaatattttcattaggctccgggagtacaatcggatgttgtaacatcgtttgtaaataatgtaacatgagaaaagatttatcccttcttctgtattattgttttccttcgattgtatttacaatataggttttacccgcctttgtttcgatgtcatattcataaaccttctgcagtttgggagattgcgcacttacccctttggctacaagaggccgtttgataggagtggtggcgaataatctatttgagcactctttcccgtttacttgttttaagcctttccctttcagtgggacataagaccggatgcggagcgtaccgcctatattcgatcggatgatcgctttatttaacatattgtttttccagtccatatcgacagtaaagtttccacgtgccactagccccttcacacttccttcttcccatgcatcaggcaatgctggcaataaatgcacggcaccgtcatgactttggagcaacatttccgctactccggctgtataaccgaaattaccgtcaatctggaaaggcggatgggcatccagcatattgggataggtacgcccgttcggatattctttagccaagtgatcgttgggcaatagttgaatcatatttttgatgatctggaaggcatggtttccatccagcatgcgtgcccagaaattgactttccagccgatactccaaccggtagccttatcaccgcgttgcagcaatgtgtttcttgctgcctggaataactcgggattcgagtatggagaaatttgattactcggatatagcccgtacaaatgtgaaatatgacggtgctcgtccttgggattgtcaacatcttcaagccattcttgtagttggttatgttttcctatttgcataggtggcaacttctctagtgtttgtttgagggagtcttggaaagaaggggcttcacctgcgatgtatgaagccaataaggtattatgcagtgcatcaaaggcaatctggttatccatggtgcaacctgccgtgataggaccgtgttccggtgacacagaaggcgacactaccaaccatttatacactggatgttctaccaagaaatccatgtagaactgcgctgttcctttcaggatgggatagtactctttcaggaactctttatttcctgtaaagaggtaatgttgccagatatgttgtgctaaccaggctcccccactaggccacattccggctgcagcaaagtctacaactccgcaaattcgccataaatcagtattatgatgcgccatccatcccctacaatcatacatagttcgggctgtttctgctcctgtgacggataaatctttcaacatagagaatagcggactatgtgtttcacttaaattagtgacttctgccggccaatagttcatttctgtattaatgttgatggtgtatttactatcccaaggtgcatgagtactgttgttccatataccttgcagattagccggttgcccacccggttgcgaagaagaaatcagcagataacgtccataatggaaaagtagagctgccattgccatgtcttccccatttccgaagttttcaattcgtttgggagtctccagttgggaagctttgcctgccggtagtgtaaggcgtacacggtcaaattgttttttataataagcgatatggtttttgagagctttttcgtaaggtatttgcgtcgctcttttcagatattcgctggtccgtcgggattcatcggcgctgacatcctggtagtttacgtagttggttgctgccgatatataaagggtggcttctgttccttcattaatttggagcgtatttcctgccgggcggagagtgccattcgtttttacctggatttgacattctgcccgtagtgcggctttcaaaccttcctgctctttcccttgacaggtgacggtcagcttatcattctgaacattcaccttatgtactagagggaagttatatgcaatagtaaagttcagtgcgtttgctttacttgctttgatatgcataataatgacattatcagtaaatgatgcaaaagtggtacgggtataagtgacgtcatccacttgataacgggtagttgtcgttgcattctccagattcagatcgcggtaaaagccggatgcgttttggtgttccggaaattccaggtaaagactacctaatgtcagatagctcattccgtgttgctgggttaagaagttggcgtcaatgagtctttgcgcttccttgtttctcccttcaaaaatcagtttgcgtacaaccggtagcacatgtacggcattcggggtattattattgtatggagaacctgcccaaaatgtttcttcgttgagttgtaattcttcgcgttcgattccgccatataccatggctccaagacgggagttgccaatagggagagcttccgaccaattttgtgcaggttgactataccacagtttcaggtcctgtcctgaaacaaggttgcttattaataggaataatacaaaaaaagtgtttctgttcatattgtatggatttgtagcaaaggtagctcatttcccaatacaaaaggcaaaaaactgtttctgaaatctaccttggaagtaacttctttccatatttatgttactaatatatatgttgtatgttccataggataaaataataactgccggtttctttttgatttattatcagccttgccctcttgtcaagtagcttgtttgcaagctgattaagtagggaggtataagaagggaagctggtatagttgcgttgggataccggtattgttctattaaagtaccggtatcattaatttcccacggccgtgacaagatcttcccacggccgtggtaggaactcgtcacggctgtgggaagaagctaccacgaccgtgaagaattaagtataccggtatcctgatcgaacaatagttattgaatgatataagtatgccggttgtatgacggatgtttaatggaggcttttcttgaaaggtaagtaaagctggagggatatgagatatgggagagcaaaatcataaaataataggctgacaataaaacttataaaatgttattgtcagcctattgtcagggcttattgtcagcgtctaatgtgctggaaatcattcgtctaatgaataggaatgacggctgacaataagaactgcaaaatttatatgtaaatacaatcagtgtgagtaattgacttgtctctacattgatctttttatctattatctctcttgcttttcgattcattcataaacagataagatttcttgtagcctccgtagtctacaaccaacttttccaacacgatgcccggatcaagaggtttgaaaattagtgtctgcatgccgtctgatgtattcggcacattcagtttgacctttttctcaacgatacgtcttgcaactgtcggatagtatatgctgtatacattttcaggaagctcgtttaagttatgattgaaattgatagtctgttccttcgctccttcgaatccgatactgtactcatgtcctttccggtcgtggaaagcaagagtcgatttcactatcacgtgaacagtcactttgtcgactcctttaggcaattttattttgtaggagatagaagctccgtcggtcggctgggtataaggcatcagagccatgccgctgagggtacgccccatataggggatcactgtccattccgtacttggtgctgctttagtgctgtaatagtgttcggcttccatagctacatatccgtcttgtccggtgaagacgtatccaccgacagccttttccggatgctcgattcggtaggtttgtggtaatgtatcagcggggaaattatcattccatgaggtataaccgatatgtttctgaatcatcatgttcttccatttaccgccggacataacattgttataatcgtcactcaacgctttatcccgtgcaaaagcctgttccactttatctgcccattcgttagcttgcggattgttttctttgtacaatttatggttcatgacttgtgcataatacatctcgtacaggtttaccatggcttgaacagggaagaggattaattgcttgtaggcatctttatattccggtttcaatgatatgtattgtctcaaagcttccgcttccagtttcagatattcatcagatacttgtttccattcgccggtctccaggttataagtattccggtcgagcatttctcccgttacgcgaccgttatatttgctgtacaggtttaagattcgcatagcttcatccgcttgatcttcgccaaactgctgtgcgcagaaacgacggggatgatccagcaagttagagacgttgaattgcttgggattccatgccatatccatgaagagcgtgatcggatattccattggtttcaaatcgcctacattcagtatccacagcttttctactccgtaatcgtatgtgagttgaagttgctcccacatattttgtataggggttacgttcagccatttggagtttctcggagcacctacgtagtctacatggtaatacatgccccaaccgcccggatgcttacgttccttggcatttggcagacggcatacattgccccaattgtcatcacataatagcatgataacatcatcgggcacacgcatacctttatcatagtaatccagtacttctttgtatagtgcccagacttgcggggttgctttggcaggtcgtttagtcaccttttcaatgattctgcgttggttctttactatgtcttccagcagtttcacgttggtgttttcgctcatggctgcgtcaccgtctccgcgcataccgatggttacgatatcttctgtgccctgcatccgttcgataccttcacggaaaaactgatcgatcacttttttgttagttgtataatcccatgcaccatattctttgcgcttgcgtgaccactcctgatggttgcgtgccattggttcgtggtgggatgtaccgatgatgattcccatttcatcagcagtcttactattctccgggtcgtctgcatagaaagcccagctccacatggcaggccaaaggaaattaccttttaggcgtagtatcaattcgcaaacttgtgtataaaaacggtggtcaccatagtttgtgccgtaggtctgttttacccaaccggtcagacagggcgcttcatcattgaggaagatgccgcggtaggtcaccgcaggttctccgtctgtatactgtcccggctttacatatacattctgttgttttcggatagggacgtctgcccaccaataccagggagatacccctatttgttcggaaagttcatagataccatagatcgtaccgcgtctgtcgctgccgatgataaccactgcttcatctactccttcacagggattggtgacaacttgcaggatatatttctcatttttcccttccagctcctttttatctattttgtttgcagctatcagtttttttacaaaaggagtactataggtacctacaatgacacagtgtttcgaacttacgtttgttaagaattcaggcttcgttccgcatacttgcagtatatcttgttgaagattgccgacagctatcattacccctttgtcttcggaagaatctacatatatcggacaaggaactccgttggcaatcaacggaaaatgattaccggccggtgtgaatattacaaattgttcagcggcaaatgccactatactcacaacagagaggtagaagaatagaaataatcttttcatggtttcaatatttaataatttgttgttaatcattgatcttacgtttcactgtaaccggatattctattttgcagataattggtaattgaaaagtatataacagcaggctcaaaatgatgtaaatatccttcttcataaatactatatttaatgaaattatcttctttgtgtcttaaatcccaaaaatggtttatttttgtctgtactgtgacacgatgcaaagatagttggtattgataagaacgggctttgggtatgtttcaattatttatactgttgataccaatttactttttcttgaagttttttcttcggagataaaatgaagaagtgtgaacaaactgctttgttcaataaatgtttttgattttgtttcaaaatctttttgtattgtatctatgaggctgtcggatgaataatgatggttaatgtgtcatattccgtattaataagattggtatgtgatgcgtataatataagttggtttaacaagagtaagtagagattttaatgatcttgagaatatcggtaagcgtcaattgcattcttaaccgaaccgtgtaacagtaacaatttttgtgcatggtcatgatttaatcctagttcctccataatcatcctggtgcctctttctaccagtttatgattactaagctgcatgtttaccatcttatttcctttcacccgtccaagttgaatcatgacagaggtgctaatcatattcagaatcattttctgtccggtgcctgatttcatccgggaactgcctgttacatattccggtcctacaatcatttcgatggcgacatctgcctctgccgccattggagaatcgggattactggtgatacaacctgtcaggacaccgtgtttacgggcttcccgtaaagcaccgattacgtacggggtagtgccggaagcggcaatgccgataacggtgtctttttcgttgatctggtgttcgacgagttcttcccaacctcgattttcatcatcttcggctccttctaccggattgcgcaaggctgtatcgcctcctgcaatcagtccgataatccagttgggagacataccgaaagtaggaggaatttcggaagcatccaatactcccaggcgaccgcttgtgccggcccccatataaaagatgcgtccgccttgtttcatgcggggcacaatctgattgacaagctcttcaatttgtggaatagccttttgtacggctaacgctactttctgatcttcctggttgatatcttctaagatctctcgcacagatttcttttccagatgatcgtaaaaggacggttgttcggttatttgcatttttataattactggttataaattacaataggtaaaagaactattgttgatggtattgaatcagcccttccatcggactttgaagaatcttaccgatctgaattcctgttgtttgcgcagcctcctgcaaaatctccttgtaacagtgagctacggaaccaataaaatgtaccggatattgcttataatcatattgcatcacgtttctgcggagaaaagcgataaagctgttgagtactagtgaacggatagccggttcttccaagtgctgtgcaaggaaaggggagagactagccagaaaacggttcggaaagggttggcggtaaacgcggtcgatgatttcgggggccgtcaggtcgaactgttttaagaaagcttctttgatggcgggtggaagctggtttttcagtacatcgcctaccagtagttttcctaagactgcgccgcttccttcatctcccaggatgaatccaagaggggagatgttgttgacaatctcttcaccgttgtagaaacaggaattggaacctgtgccgaggatgcaggcaatccctgcttcatgtccgcatagtccgcgggcagcggcaagcatatccgagttggctttgatatttccgatgacaggcaggctgtcggcgatggcccgccggaggacgggagccttttcgggagtgcagcctgcaccataaaaaaagacggagttgatcgttccttccggtagttgtggcagaagggaatgtgtcagctcttgttgaatttcttcttctgattggaagaagggattaattcccttcgttcccattcgtttgattggggtgtcgttgaaaacgatgcaccagtcggtttttgtagaaccactatctgcaatgagtatcatatctttgagttttttattgtttctttccgaaagaatcctccagtcggttgcgaatcattaatgaggcgacgataccgggtagggtacaaatacaaacccagataaagaagtttgtgtatccgagatgttcctgtatccatccggcaggcataccgggaatcatcatgcctagtgccataaatccggttccgatagcatagtgcgccgttttgtgttcaccttctgctatataaatcagatatagcatataagcggtaaaaccgaaaccataccccaactgttcgatcgctacacaaatggctataaatataggattgtccggggtggcggcagccatccatacatataatagatcgggaatgttgatggctaatgccatgggtaatatccatttcttgaatccgtcacgggaaacgaggaaaccactaatgattccaccgagcaataaagctatgacacctatcgtaccgtagatcattccgacagttgctgtggataaacccagtccacctttatcggtcgtgtcgagcaggaaaggagaagctattttggctaactgtgattctcccaaccggtaggtgaggaggaaaaagaacatgagaccgaggttctttttctgaaagaatgtgacaaaggtcaggaggaaatctcccaacaacttacccggtgtgagtccgggacgtttaatgtccgaatcaggatgggggaggataagccgatgatagatagtaagagccagaaataatccggcaaggaggtagaatgtaatactccatgccaggggaatattgttctgtgatgtttccagccatcctgccagcatgactagaattccctgcccgaaaatattggcaagccgataaaacgtatttcgaataccgacaaagaaagattgttctttattattgagcccgagcatatagaaaccgtctgcagcgatgtcatgcgtagcggaactgaacgccaacagccagaaaaaagcaagagtcaactgtacataatgagcagtcggaataaagaaggctattcctgcaaatccggcagcgatgaaaccttgcatggcaataatccaggcacgcttcgttttcaccaggtcgacgaatggactccatagcggtttgatagtccagggaagatagagccaggaagtgtataaggctatttccgtattggataatcctaaacgcttgtacatgataacagcaatcgtcattaccgctacgtatggcagcccttctgcgaagtagagggtgggtatccagctccagggatttctttttatagtgggggttgtcatggtattattcttttttattgatattgtttctcgagcgtactgccggggtaatagtgagacagtatttcttcatatttgtaaccttgctctcccattacggcagcaccaatctggcaaagtcctactccatgcccccatccggctccagtaaggatgaatcgtgaagggattttatcctctttatgtcctttttcctcatattccttgtctactacgaaggcggaactatacagatgggaagtagataaggtacggcgtatttccagttctttcccgataataagcgttcgcaaggttcctataattttcaatcggacaagacgtcccgacgttccacgttctataggaattaaatccagaatttgtccgaagtcaattcccgaacgttgatgaatcagtgttgaaagttcttgttgggtataactgactttccaacgatagaagtctgctgtttcctgatcgtagttgtttagtacttggcttagaattttcttatcctgcgtattacaaaaagcaacaggtgaggtacgtatccatttatcagcttccgcctctatggtcaaatcgggaagttgtttttcagtcttactatcccgttgtctgattagataaggatgctttacgttttcccaacaattttggaactcttcaaaagctccgccacaacatttagagaaacgggcatcacaaatcgctcctttatacatcagcacttccccccgcgtggcggagactgcttcgatggcttgtggtgttgaggctcgtgtaattccctgataacgctggcaatgatcatcggcacatacatcgaaatttttatgtgcttcatggtcataccacttaataaatgaagaattaggaatgaagaatgaagaattggctgcgctgtctttttgcaaagttcttttaaattcttcattcttcattcttaattctttatttttttcgagtagccagcttcgggagatgacggcgtgagcctttagtagttctaaagaagctgttgcgctcatctctgatgaaattacactggtaagatattcttcaatggaaatcacattgatggcggttagttgttctccttcgatgataatctttaattcccctttgaatttctggacttctttgcgttcccaatggaagttgattccgatggtcacatctttcagttcaaagaaagcatgtgcattttgtggaggaatgaaggataattcgtcgtactctttcccttgccaatgaatcttcccatcctgataaataactttctgtgtcccggaaatttccgttccgacagaagaactaaatttcaccgggaaagagaattcaatctctttcccggaaaggataccgactgttatttgaggttgagtcataatacagctttaatacgttctagtattttttgcagtttttctttggatatagatatttcccgatagatatcatataccttttcaggagtcagtttctccatatcctcttcacgtactatagggaatatgccgttcatttcagcaatagcaggactgatgagaatttgttcgtctccttttgcgtaatagcagtcgggacgatgtttgctgcgtaagaagataatacaattgtaagggtgttcggccactgactcaaattgatcgtcgtagttctttccaaaatgctctttggtgatttccaaaccataccaggcaagaatattcatcattggttcttttccgttgttattggcagctaaaatgtcgtaaatcagatgaaaggttttcgacattgttttcttatttttcgcctgaatcctgatgaaactgtacgggaaatcttcataactaattcgcaccttgtcgttatctattaattccatgtgatcgtaatatgatccctgcatactttcctctttactgcaagcttgaaaatgggcatgatcgggagcggaagctccacattccggtccattatacaaaaggaagtattctctcattatgtcggtgaattctatcatatctttaaaacgcccgactatggattgcgacttgtgttccttatctacaattgtaaagtggtgtttgaatatgggatagggattaaccagtatctgataattcctataactgatgaactcttgttcctgcggtcggtttgtttggcagaggaagcaaggtcgtgaatgaatggaggcagtgtttgtctgtgcggtagccgaaagaatacgtttcggattaaggaataggttcgcagctaaaccttgattaccaaaccatttggatatttcttttgttcgtgaccgatactgttccaatgcttggtaattctctttggctagttcccaagaaagagtttgcttttggaataactgttcgattttttgctgaattttctctaatgtcgtttcttgttgcaggatgcgctgttccaattcccacgtacgaagtcggtctttatatagattattctggttgattttctcaacaggcagtgcagcatccgagttgccttcccaacggcggcaaaggtaaatcacgtcgtatattctgcctatctgataatcgtgtgaaattttcaatccaagagcataatcttctccatagcttgtgttcgggactttgatttcccgaagaatgggagtgtagaatgcacggggagctcccagaccgttgatacgtaatgcattatttcgtccgttgtcgggcgtccattccttatgatcgatgatgccgggggcaatttcctgcatatcaaagttagtcatcatataagtgccgattaccattgcacatttctgtttatagaaagtatcaatgatgatttgcaggctatgttcgtctttatacacgtcatcgctatcaagttggacggcaaactttccgcatttctcgtgatggatacctatgttccaacatccgcctataccgaggtcatctctttcgggaatgacgtgaatcagccgcttgtccgaactaagttcatggagaacttcactggtcccgtctgttgaatgattgtcgatgataatgacattgaacggaaaggtcgtttgctggttcagtgccgagcgtacggcatctttgactgtgcgaatacggttgcgtacgggtataatgacagaagcttcatattcaaaagtgtgagaagaaaagtctacgggacggaagataggataaagatatccgccaatttccttcaaatggttggtgcatgcctgttccatttcaatctgtacctgacggtttttagggtctacataatcgaactgcttctcaccgcttttccgcttgtcactttctacttcggtatatagatattcgttgatgtgtaccagtttgctcttttgggatattttgagtctcaaatcatacaagcctgcatattgatattcctcttccgtattttctataacttccttgaatgcgttggcattgaacagtaaaaccgagccgaaattgaagtcgtcacgcaggctaccgggttggtaatcaatgaccggagctgttttttgcacaccgtctatctgttggtaatggtctgcatataccatgccagcttgggtcatttccattacttgaaccattctttcaagagcgaacatgcctatttttagtgcagtgtgtttggtatagagcaaggtatatgttttatcagaatgttctgcaatagctcgcattgcttgtgtagactgcattttttctacagagatgagttcgcatccgggaatacagacattggtaattggcgatgccaataaataaattttgtctaccagcgtcgatgcacgtaactccttaactgtttgcacagtttcttccaaccggctgaaaggaagaaaacagttgattgttgttttcattattttactttttgttttgtagtatgagttgtgtaagatgtttctttgtcttgtcttttgatgaacaaacagagtccaaggaatgtgaacagggcattgattatcaacaactcgtaactaatttggtaaccgttgagccatgcttccgaatttctttgaaggatatagcaaagaataggagaagcgatagctaccaacggaatatatttatcataaacttgtttcttggtgaagatgccgaaagcgaacagtcctaagatagggccatacgtataactggccaatgtgtaaatcgcatcaatcacactcgtgttgttcagcagattgaatacgaaaatgactgctcccatcacaactgccataccgatatgtacatgtttgcgtatttggctaagtgccgcctctccttttttctgtgcatgtaaaatatctacagtaaaggaagtggtcagtgccgtcaaggcagaacccgctgcagaataggcggaggctatcagtccgataatgaataatattccgactatgccgggaaaataatttccggtagcaatcatcggaaacaactcgtcgcttttttccggattcccaatgccttgctgtgctgtaaacgtatataacagtactcccagcatcagaaaaagcagaatgacaaagaactgtgagattccactggtaatcatattcttctgtgaatcccggaaattcttgcagctaagattgcgttgcatcatatcctggtcgagtccgttcatagcaatgacagtgaacactcctgctaggaattgcttgaagaaatagcgtttgtcattaacatcgtcgaagaagaatgttttggagaagtcactatctgatatggtagtaatcaggccgctaaagttgaggtgcaagttggaggctatataatagatacatagtatcacagagactaccaggcagaatgttttcaatacatccgtccatatcaatgatttcactccgccccggaaagtatagagccatactataaatacggtaagtatgacattcaacaggaaaggaagatggaaaggctcgaagatcagcagttgcagcgtcaggcataccagaaatagtcgaacggcagctcccagcatctttgagataaagaagaaccatgctcctgttttataggatgaagctccgaatctgttctccaaatattcatagatagaaaccagattcatccgatagaacagtggaacaagcacaaaggcgataataaactgtccgactataaagccgagtaccatttgcagataagagaaactgctagcttgtaccatgcccggaacagatacaaaagtaactcccgaaatggtggaaccaatcatggcaaaggcaacaacataccatgccgatttacggtttcctacgaagaacccttcattgtcagctttgcgtcctgctatataagagatagtgaacaggattataaagtatgccacaatagtgatagatataacggctggactcatatctgctatttaaattcgtttgaggatgaatgattcgaataagtttatctttgtctacaaaagtagggaatttatcatagatatgtatactcttacctattttttattcccggtgtgcctccggtcgcgtgtttggacgaacgccagtttttgttgagcgaggacaactccggagatttcttttcaagcgaaatgccggttgtctttttgttgtcagaatcgtgcatctcatctctaaaacggcaagtatcaaaagtttgtcctttctccggcttctcgctacaggagagtgccagatagcctccgtcgttattaagagtcgggaatttgggtatttctatcaggttctctccatttactttatgtttccgaatgaccttgctggtgtatttgctgaagcaaagataacctttggatggaatggtgatgggagtggaggaactctcgttacaaagagtggtagtactgtatactgtgccactttcatacattttgtatagatagagagttggcagagtaatagtcttttcacccggattataaatttctacatattctgcaccgtcagtagcattatcatacattatttcgttgaaaagaagcatacctctcacatcttccggtaattcgggagtgtcgggattgtccggtagaaccgtatcgggggtatcgggtgtttcgtcgggtgatgtgttcgtttctacgtcattagacaactgtatgtgatggaacgtgaatcctttacaacgggttttggtgtaaatgcagtatataccgcagtagcgggaagtctgtatatcggtatcttttatctgtttttcttttacgtattcattctcggattcaagccgtgtccaaaaagtccagtaaccgttattgtcacgttctacttttatatatagtttcggtgatgagtcgcctttcatcagttctcttcccgaagccagtagtttagactgctctccgttttgacgataaagagctacattgtcttttgctcctccaatctgaatataatagccgtttaaattaccggaaagaatgtttgaggaagaagtcagataaaatcgtgcataattgttggcggaggggttgaaggtgaggtgaactccaaattcccaacgggtattttttatagaggtagaaggaatggtgacataagctgttccggcgtcttcctgtggatcattcagatggattccttctttagagttgatggtgaatttgtccatctctccttcccagggaagttcgggtgtgatagtgtctcctcctcctaattctccctttttttcgtcatcagcagggagcgaacaattatagaacaatatgatgaagatacttaggaaagcaaatgcttggtaaactttcatacggtttttagtttgagttatttcgttttaccgtatttgtttgagtataatgcagaagcaattgcggtttaaatagttgaatgagtcggcaaaggtaaacctttttgctggaaaaaacatacttattgaagaaataattgtaaatccttttgttttctctaaatgcgtggaaaggaaacagtgaggggttatcaaaagtcaataaattaaatgtgacttttgataacccctcacccatgttacattcaattattgaaacattattcgaagcgtggcattacatatttatctgtgtaagatgtgaacgtaatacctggcatggaatgaacgttcgattcgttctccagcttctttatcagcgaataatcgttggcatccaatgcgtaatagttatctgaagccggagttgtcacgcggactgtccagtcgaacatattaccgatgatggtgagcgcatccgtttccggatcaaatgccgggattcctgttttaacgatttcatacgtccggttctgcaacacatagaaagccttgttgacatcggtcataaaagcaagcgtctttttgtttctgaactcggtcagatacagatgttctaatgtcaggccttcaggcaaggtgatggcacggacatacgggcgtcctttcacctgtttcagatgaaacagacgacggtcggcatccaacagaagataaccttcgtcatactcctttttcaccgtcggatttcctacgatttccgttgccggaaaacgaaaatccttcttagtcatagcttcggtaaactgaaggcttttgtcttccttcacgctgttggtagccatgtcgataaattcgatccctttggaggtgatacggaatacgtcatccggcattttcaggtccacacgtcctgacatagattccatcagtgggtaaagcccgatagaaggtgcgtttatatccgaaggcacactgcggaagttgaagttttctgtctgcaccattttaggagtcattgcgattccttgaatggtatccggaaaacgctcatcagacatcaactgacggaaataaaacataggcaggatgctgtcgaaagcagcttccgaataaatgtttcctgcaaggtcgcggcgcacggttcctttcccttcttcttgtcccatctgggcgaaatcgccaattacgaaactatacagggtaaagggagtcttttctggctttacgacaaagaaattgtagcaccagggcaactgccaaagaagcagaaaagcgatggttacatataatagtatggtactgaaacgtctcatttctcaatcttttaatttttaatctttaatttttttattggttaatcctgttttccggccttgaaccgtacgatagagagccacgagaaagaggctgtcaacaaagtatagaccactaaataagggagaaacttgttgtatgcttccggcataggcgacaggaagaagattcggagtaacaatactgcgataatgagattcaggatacggcgtttccatgccggttcgaggcaaatccatgcgacgagcagatagccggagatgccggcgagataccacgttaaagcggtaagcagtatgtggtttttgagctcatgggcaaggattccgttcagatagatctccatcaacaggaaattggaagcgaagcagacaagaagcagtatgagtccggagagtaacatattgcccgtcattttcagttccggataaggcagatggagggtcagtttcaaacatttgcgttgcatctcggggacaaattgcacgattgccatcaggattccggcaatcagaggaatatattgcaacatatcaatgaagatgacatcccgttgcagcatgacttcccatacatgggcagcccctttcatttctaccacccggttgatacggagcatacagtagcctgtaaaaccaagtgtggcgagcacggcaagcagaaaataccaccgtgtctttatccattctttataaaatatagcgtacattcttgaggatttatgatttatgaatgatgatttatgggttacgagttgccaactcttattcttaatttaatcagtatttcccggtgaggccgataaaggcatcttccaaattgacttgctcacagtgcaagtctgtatagggcactgacattgatttcagtttggcttctgtttctgccggttgcaggaaggagaaagtctccaactggttccgcatgatggaaggatggtagaaatcatccgatgcaggaagctcgtaaccttcgggaatggtgaaggtgtagcggcgtcctttttccagtaattcggcgattggtttctgaatcagtatctttccgtagtccataataatgcagtcgtcaacgagacgctccatatcctgaatgatatgcgaggtcagaaagacggttttaccttccgaacgggcatagtcgcggagatagtccacaaacaggcggcggtagccgggatcgagtccgagcgagaagtcgtccagtaccagaagttccgggttttgtgcgagaatcagtccgagagctacttgagagcgctgtccgcaggacatacgtgagatgcgctgtccggtagctactttcaatttattcatcagttcgtagtacgcttcttttttccactggccggggtagaaggctgcgtagaatttttctatttcggtgatggtcatgaattggtattgcacatgaccttcgatgagcagtccgatatggcggcgcagagccggtgccatggtctgtatctcctgtccgaagatgcgacattctcccgaacggggtttcaggtaaccgctcaagatattgatagtggtggttttgcccgtaccgttctttcccaatagtcccaggatacgtcctttgggcactgtgaaactaaggttttcgtaaatcaaccgtttaccgtagtagtgcgtcaggttgttacattcgataatttgttccatttgattttatctgttatttcgattcaaaagaagaaaaggaaaagaatgggaatcaagattccgactattagttctattcctcctctgccgataatgcccttgttccctttcagcatgataatgccggaaagagtaatgataataagggcgatagcgaaaatatccgcgaagtaagtccaccattgtcccggattgtaatgtaaacgggacatcgctccgataagcgggcgacgggtgacggattcatataccgcttctcctgtcttcacgtttaccagaaggctggaaccgcctttcaggaagactttcattacgtccgttttcgggaagtagtatttggtatagttgccggtttctcccaaaggttccagtagagtaagtactttctctttactcattcctgctttgtccggtagcttttccgctattttatattctttccgtgtgatggagaagttcggattaatcgtgtcacggtgattcattacaattccggagatggcatatatcaataccattccggaaaagaaaaatgacaggtcacggtgtatgagccggctccatttacgaacagtactactccacttcatacgagttggcttccataaaatagaaagataaatactcttttcctgtttctgctttgcggtcggctatttttgcgcggaagtctgcgatgcgggcttcgggactgttggctgtttcgccgcgtgctttcttttcagaatcgcatccggcttcaccggttccgtgtttttcggcagcttgtgctttgagttgtgcttcccagttttggaggtaggcttcgtcgatgcgttgttctttcaatgttccggtaacacggacaatagagttcacacatttaggatcgaaggctcccaatgttccggcttctacacggatcacttgggtatcgtcactgcccatcaggaagattttctttgcaccatgtttgcaggtatgtgtgcaaacgccttcaatggttacttcttgtcctgcaaggttttcggcattggcaaggagagaatcaatttccaaagcggaagatgcagactgttctgtagtcgcttctgatgcgcttttctgttgtttgttaccacatgaagttccgataaaagtcattgccataagggcaattgcgattgttagcttttttgttttcattgttattgcttcgtttttatatagtttgtaatctgtttttcgtttgtttatagcttttaatagttcgccttacgggcggggagtttcaaccatgcttgaaacaaatactactcctttagttggcagcttgatcccttacgcaacggagttgcataccggctttaatgctgacataagataatgataatctgccttccgaatactttgcattgattgtactcattaatccaaagaactgtatattggtaagtagtccgctggtgctattgtatacgggcttgaaggcagtcgaagtcataagataattcattgccggttttccgtgccatgcagtttgaatattggcatcttctgctattgccgttttttgatagctgccggcacctgtaaggcttgttgccatacgaacgccggagaattggtaattgaatcctgcattattcagtgatgatattttggcgccgtcataaactgcatcatagaaaagagctttatcaccatcagccggtaccttgccgtcgacatcattcgttgtttttcctaccagattaaagtattccagacgtgttggtatgtgccaacctttcggacaaataccttgcgctccttcaaaagagttcagattgctttcagtaatttccttaccgcccagtgcaacttggaaatcatatagataacctaattctttgatagcactttcctctgttgtggctacggttgcaccgtcagctttgatttcatacgggtaccaaacatgactatcagcagtaggatcggtagaaggagtatatcctttcggaagataaataagcggttcagccatccacgtagtaccgttcgccaaagttaccgtgttatattttacattatcgtataagaaatagttctcattgagatgttcttcgaaaggaatctcattgtctgctccgatttcaccttcatctgtccagttttcgatgtcaccgataagtttaacctctatatcgtcaggcaatacacggatgtttacgctgtattgtcctccttgcgctaaagtagtagatgtgagtttctgcgacaaggtcttgccatcagaagttgctacttcgagcgtcaaagctaccgtttggggaacgatgagggcgcggtaagttttgttcgtttcaacaacctgtgccgtaatgtttgtagctgcgacattcgcgtcagcagtaactgtaagggcagccagatcaagagttgcagtcgggatagagcctttcaatgcaatggatgttatgttggcttctacttcctttgttacattaatgaccagtttggtaagcagatgcttaaagttcattgttatagtatttacagtaggaagtacatctttattgcttgctgccataaggtctgatgccccatatccggtggtctgatcggcttctacagaaaaagaagtaggagtattaccttctctataaggatagtatgctactatctgcgatttgtcatttccttccgggtaccaaagcaggtcacctgcaaatactccgtcattgaatgtcattagtttattttccgcatatacgaagtcaccgttttggatgattgtaacgccaattttatctccggtttcaaagttaacttcggtagcgcgtgtgataacaggcgagatagtaatacgactgtctgaaggagtcgtcgtttcgttctcttcctgttggcaagataccaaaagtgctgctgcgaagataaatgttaaactctttttcattgcttaataatttagtttatatatatattcattgttttcaaaaagcatatcccggttctcaaaaagtatatcctaacttgatagtctcattccaacggctcgaaccatctatatagtgaaggttgaaaccgcgtgtataacttccctgtacttcagcatagatcccatggttgaaatgatagcgtaaaccgagacgaagcgttgcttgtggagcagtagcatattcattctgcagattataataatctgtcaggcgatagggaggatcacccggctccgtatctgttgtaatgactctgcttttctcagtagagtttcctatggcaaaggaagcggctgcctttaagtcaaatttccctatatgaaacacgctggatacatacgtctgcgtacaaagcatcttttccgacgctacatacggatacatctgggtagtcagtcgtttgaaagttgaaatatgtgttcccaaacgaacttctgtacgaggacttataaattcatattcgggatggaccgagaaagcatctctttcgaaaatgcggttggagccgttgatataagtcgtcgttattccgttaacagtctccttattaatcacattctcgttgttgaccaaatgtgaccattgcaggttcaatcgtagaaaatgctctttctttccctgtttgaaatgataactcaaatgagaggcaatccggtgagtggggaatttgaaccagatagcatctctttcaccggcagaccccgaagaataggtatattcgatatctccataaaatctcttccattgaagttgcagtgctcccccgttagacagttctttgatcggaaagccgttgattcccgattcgcttagatgaatcccgctgccgtcccatgcttcataagctccatacatcagtcctttgtccaagaaggcgttgtaggagttttcggtagtcccgattacttccgccttgaccgattcgctgtttttgctgaacatataagaaaaaccgatggctagatcgcccgagtgatacatcacactgggggctactttcaaatccagccggtaattggtatgtcgcaagtctttccgtttggaatagttggaggcggcaaagtcaatctttcctcccaatcgccagttaggtgcaatatctgatgcaataccgcccataaaagcgtatcgttgcaggtctttgcgtccgggagtgaactctagaatgtctaccggataaaatcccggctggataaacatggaaccactcatgtccttaccggaagtatgatcgaatgagaaagaaccagtcagcgaataccctttcagatgagtgatagacttggctattgctccggcattccatgatttctccgcttcgtaagagtggtggaaatcaccatggttattcttaccatacagttcggcataggaagaagagatgctatccatcctgatacctgtaacattttttccggtattccaggaattacgccgttctataatgtcgtaagtctgtgccgaaacaccgtacactatacatagtaaccaaagacctgttatatatatttttttcatctcactcatgcaaagattgtttttctctttcataaaaatcggtagaagagttgttggtgtccatcaatacttcataacctgcttcctgcgtagcttcttcgtccacatgtcgatataagctgcgtccgttgtatgtcgcactttgagtgacatatcctgcgtcgatggaaggagatatacgtttcttgttgttggaggaaccaccgtagtacacttccgctccatcaatcacccagtcgagcggaactgctatcacccggtcggtggtacttcccggtttttgtatcacacttccctcttttagaacaaagtcctgtatcgtggtatccttagctttaaagataaccgtagcaggagaaaagatagagaacgagtaagcattcgcctgtccggttttcaataccacgttcagataatgatccggtgtgatttgatcccccggagccggatgatactgtgtattcggaaaataaacgttattgtagcagacaaagtatcccggtttgttcagattgacagattgcgggtattgcgctgcatggtcaactgccccattgatggcaatcactgcatcttctcccggttgaagcgggaaagtcttgccggtaccgccaaactgccagatgcactgaacgatgggagcaaaatcccggaagatggttgctccggttatttcatcctgcgttacccagacattggtagcttgggaattgtaaggatcaagcgctccgaaacataaactatcgagatattgcacttccgaatcgttattatgcaggattatatatttgtcggactggtagtttccctccagcggcaactttgtacatcctccgcaataaatctccttaataataatagccccggctctggaatggatgagcgggaggttgaacgccatgtttccgctggtcagtttcacattatcggccagtccgttgaaaatatcctgtccgtccttgtcgctgacctgcacgcgatatatacctttagtcagagagaattgcgccactccgttcttgtcggttttagccttgtaagaatttccacgatcgacatcttcaatctttacggtcactccttcccggagatattccgagtatccatccgggtatacggcagtcacttgcaggctgtgcaactgatcgtcgtacggattctctttatcaagatccgtgcatcctgcaaagatcccggtcactgttagtaataatatgtagatagactgcttcatatctttaaaatttaatacggcaagtaagtccataatagaaatccggggtaaagagcgcgctcacaccggttgcatgagattttacatacggccgtgaattggtgaaattgatagcgttgagagaaagagacacatggtcgccaatctctttggttatgttgatattggcggagaaataaggatcatatccatccgctgcaaatgtgtaggcattgcccgatttgcgtatcagataagagaattccggattctcggcttcggctgacgtgaaaggatgcatctcattgttcaggtcgagatatgccaccggccagatagccgtataagagtcaccgttataaatgcttccacccgtttgggcattgctgctttcacttacgttgaacgcgtattcttttcccttatattcggagatattctgcgaacgcttcacaagcgaagcctccagtctgcatgaaataatcagtctggctttcggaatacgggtgatggctgtgatattggcatccaatgagtgggtacgtttaccgttggcagtcgtcgataagttgtcgccattggcatagatacctacatattggtaggagcggttggcaagactggtgtgcgaccatccgttctgataataataggacaaagaattgtcgatatatttagtataagcataggaggcatctaaccggaattgcgtacggataggagttatttccgggaaatcaacaatcatttccgctccacggcgaatgacgtccattccattatcgggagaggttgacttgacaaaagtctggtcggtcacctttacatccataggagtccagtagctcgatgcattgtcacgtatgtacaccattcccgtctgattatccacattgatttgcggattagtcggcatagtgaatccctccggtaattggagaacatcgtaagagaacgggttataggaactcgtgtatttatacggtaacttggtacggttgaaataaccgactagcgaaatcctggtccgggctatatggacgtcaatgcccaattccgaattctgattccgttgccagcgtagattctcattgtgcagtaatgtgtagggctggctgtaatagatataagatgattcattgttattataggaaaaaccgaatgtctgtatgtcccggtattcctgtttgaggtacaaggtatagaaagagggaagcttttcagtgattccccaaccgccacggatagcgatatgttcgttcaactgccatctggcattgaaacgtggtgaaagagtattcaggtttttatagttcgttcccttgataaacaaatgttcccaacgcactcccgccatcagtctaagcagggtgtttcccactggtaacgacagactttcttcggcataaagcgaaacgttatgcatatatggataagcggtgtaagggcgggggcgataaccgttcggagccagtgaagggtctttgtaatattctccttcacccacattccctgttgctttccactgaacacccgctttcaggttgctgtttacagtcttgaaccgtctgttccattcatactttaacgatgcggcataatccagttctttggagtcgatgatctgatctgcgaagtaggtatatggcagtttgcttgccataaaatatccttcttgcgtggcatgaacagccggctgttccgatgcatacgaatagaaagtatgtgcatgggagttattgtcattgtagtataccgatgcgtcgaacttgaggttggtgacccacgatttattgagcagccaggccagtgaagtgtttgcccggaatacgttatccctcactttgttgtattctcccgaataggcatccgggtcatctttggtattcattcctccgatattacctgtaacaccgatatcgaatctgaacactttgctgaaagtgttgctatatccggcagagaatccccttcttgtataagacgaatagggagataccaacttttgggtagcctttgtccattctccgtttatgttgataacgcctttgtcgtttcctaaatccaatcctttggagaaggaaacctgttcggtgcggggattgatggacaataatatgttccagggtgttttccctttccgggtgtgaatcttgaccattccgctattcaaatccccgtattcagccgaaggtactccggtgatgacttcaaccgattcaatatccgccacggtgatattacgggtatctgctccgttcatatttccaaatgagccattattgccaatacgtaccccatccacttcaacggctgtcccaaaggctgcattaccgactgtcgaccctccgtcgcgtaatgagaagatattattagtggtaagatccggcacttttgtctttcctcccggaagaagagcggagatatcgctcacgttggatacctgcaaatgttccagcgcattattaccgatagtgagcgtagtgtttaactcattcttgggcgcttgtgcagtaacgactacatcatccagtgcaagcgtgttttctttgagttctatatgtaggtttttgatattactgtgcacatttaccggaattgttgccggtacataacccagaaaagaaacttccagattatattttccctcctgcactccttgtatcgtgaattcgcctttctgattggatacagcccataaataggtgcctttaatgagaatggaagcaccgggcaagggggaattcgttttgggctcggtcacacgtcccgagattgtatagatgtttgaattagctgcggcctcaaataaattgaaaaatagcagcccccagaatgctatgttaaaaagacaatatttcatagataagttttgtgcaaaattcgataaaaaccaagtttatatcaatcactataaatagttattttcacaaatcttaatacctgcaactggggatcttttacctaataatgggtaccttttctttaataggtaatttagaaaataaaaaaacggcttgcattgcgatcactatcacattgcaagccggttgatttattgggcttatctgtcattgaccggatattatatccagtctattgtattagatattttttactttaatcagatattcggcaatctgaacagcattcagggcagcgcctttcttgatctggtcacctacaatccagaaagtcaatccgttttcgtttgtcaggtctttgcggatacggcctacgtataccggatctttacctgccaggaacagcggcatcgggtattctttttctgccggattgtcctgaagaaccagcccttcaccgttagcgaatgcttcacgagcttcttctacggaaatcggacgttctgtttctatccagatactttcagagtgagcgcgtaatgcaggaacacgtacacaagttgcactaacctttacgtcagaatgcatgatcttacgtgtttcattgtacattttcatttcctctttcgtataaccgttttctgtgaatacgtcaatctgcggaatcaggttgaaagccaactgataggcaaacttctctacagtcacaggctcgtttgccaatacctggcgatattgttcgtacaattcgtccatagcagcagcacccgcaccacttgctgcttgataggtagacacgtgcacggtttttatatgagaaagcttttcgatggctttcagtgcaactaccatctggatagtcgtacaattcgggttggcaataacgccacgcggacgttccaatgcatcttcggcatttacttcaggcacaaccaaaggtacatcggcatccatacggaatgcgctggagttgtcgatcatcacagcaccatacttggtgattattttttcgaattccttggatgttcctgcaccggcagaagtgaaagcaatgtctacccctttaaagtcatcgttgtgttgtaagagtttcacctcgatctgtttaccgcggaaagtgtaagttgttccggcactacgtttagaaccgaacaaaactaactcgtccatcgggaagtttctctcatcgagcacgcgcaggaattcttgtcctacggctccgcttacgccaacaatagctactttcatctttttcttttgttaaattgtgaatattgaatttctttcctgtcgaatagaaaagatttggctgcaaaattataacaatttagcatataaacatcgcttttgagagaaatatttcagtttttcggcggatttctttaaccttacgtataatcaagtgtggttgttggatcggataaatgcaccaaaagggatgcattctccgtcgcgatgcgaatcggattggtttcgtagcttgataagattatctttattgcctaatattacttcgtttaactatagtgtaacgcaaggataactatagtctcccttgcgtataactatagtcatacgcaagagacactatagtagaacgaaataaaagtgcctaatgaaatagatcttgataggtaagcgggggaaaagaagtagtaaggtgagtaattgactactgaataatacgtctggacattcattgtgattctgcaaacttttttgttcctttgcattgaattcctaaagccacagcctatgaacctgtttgattttaatttaaccttaccgattaccgacccgacttgggtattctttttggtattgattatcattctctttgctccgatgatcctcggacgtcttcatatacctcatattataggcatgattctggcgggtgtcttgattggcgaacacggctttcatgtactcgaccgagacagtagtttcgaactgttcggcaaagtagggctctattatatcatgttccttgccggtcttgagatggatatggaggactttaagaagaaccggacgaaaagtttcgtgttcggctggcttacctttctgattcctatggtgttgggaatatggagtagtatgagtatgctgggatatggttttcttacggcggtattgttggcaagtatgtatgcttctcacaccttaattgcttatcctattattagtcgttacggactgtctcgtttgcgcagtgtcaatatcaccattggtggtactgctgtcaccgtcacccttgctttgattattcttgctgtcataggaggcatgtttaagggaactgtcgatggctggttctgggtatttcttgtggcaaaagtggctttcctcggatttctgattgtgttctttttcccccgtatcggacgctggttcttccggaagtacgatgacagcgtgatgcagtttgtatttgtgctggcgatggttttcctcggaggaggattgatggaatttgtaggaatggaaggaatcttaggagctttcctggcgggcttggtattgaatcgcctgattcctcatgtatctcctttgatgaaccggttggaatttgtgggaaatgcactgtttattccctattttctgattggtgtcggaatgattattgatgtaagaagcctgtttaccggaggtgaagcattgaaagtggctattgtgatgacagtggtggcaacctttagtaaatggctggctgcctggatcacacaaaagatctatcggatgcagtcgaatgaacggagcatgatattcggcttgagtaatgcgcaggctgcggctacactggcagcagtactgatcggccacgaaattattatggagaatggagaacgcttgttgaatgatgatgtattgaacggtacggtagtgatgatacttttcacttgcgtcatcagttctttggtgaccgaacgttcggcccgccgtttcgctctggatgaaaatgtgcaagcggaagaagaagctaaacagataaataaggagcagatcctgattccggtcgctaatccggagacgattgaagatttggttaatctggctttggtgataaaggatgccaagcagaagaatgcattggttgcattgaatgtgattaatgataataacagttcggagaagaaagagcagcagggtaaacggaatttggagaaggctgccatgattgctgctgccgccgatgtgcctgtcacgatggtgagccgttatgatttgaatattgcttcggggattatccatacgatcaaagaatatgaagctacagatgttgtgatcggtctgcaccggaaggccaatattgtcgactctttcttcggacatctggctgaaagcctattgaaaggtacgcatcgtgaagtgatgattgccaaattcctgatgccggttaacaccctgcgccgaattaatattgccgttccgccaaaggctgaatatgaatcgggtttctcaaagtgggtggaacatttctgccgtatgggaagtatcctcggctgtcgggtgcatttctttgctaatgagcgtacattgatgcgccttcagcaactggtgaagaaaagacatgcaggtaccccgacagaattttccatcctggaagagtgggaagatctcctgttattgacgggacaggtgaattatgaccacttgctggtggttgtttctgcccgtcgcgggtctatctcttacgatacctcttttgaacgtctgccggcgcaactgggaaaatatttctctaataatagtttgattatcatctatcccgatcagtttggagaaccgcaggaaattgtgtcattctctgatccgcgcggacataatgaatctcaacattatgagaaagtgggtaaatggttctataaatggttaaagaaaaactgatggaaaaatacgactggcaacagagaacagcactcctgttaggagaggaaaagatggaacgcatccggaacgcgcacgtattggtcgtgggattgggtggagtgggggcttacgccgccgagatgatctgccgcgcaggagtcggacggatgacgattgtagatgccgatacagtgcagcctaccaatatgaatcgtcagttgccggccatgcattccacactgggaatgtcgaaagcggaagtattggctgcccgttataaagatataaatccggatatcgaattgaccgttctgcccgtctacctgaaagatgagaatataccggaactgctggatgccaatcaatatgattttatagtagatgctattgatacaatcagtccgaaatgctttctgatttatgaggcgatgaaacgtcgtataaagattgtttccagtatgggagcaggagcgaagagtgacatcacccaagttcgttttgccgatctttgggagacgtatcattgcggtttgagcaaggcggtacggaaacgcttgcagaagatgggaatgaaacggaaacttccggtagtgttcagtacggaacaagccgatccgaaagccgtgttgctgacggatgatgaacagaataagaaatcgacgtgtggaacagtcagttatatgccggccgtgtttgggtgctatctggctgaatatgtcattaaacgattataaaggctattatgataaaactagaaggtataacgaagagtttcggctcattacaggtgttgaaaggcattgatctggaaatcaataaaggagaaattgtcagtatcgtaggcccgagcggtgccggtaaaacgactttgttgcaaatcatgggcactctcgatgaaccggacgcgggtacggtgcagattgacggaacagtagtaagccggatgaaagagaaagaactatctgcgttccgtaataagaatatcggttttgttttccagtttcatcaactgttgccggagtttacggcattggaaaatgtgatgattcccggccttattgcaggcgtttcttccaaagaggcaaatgaccgtgccacgaagattctggatttcatggggctggttgaccgggcttctcataaaccgaatgaactgtcgggaggtgagaaacaacgggtagcggtagcgcgggctttgattaacgacccggcagttattctggcagacgaaccatccggtagtctggatacacataataaagaagatttacatcaactgttcttcgatttgagggaccgtctggggcagacttttgtcatagtgacgcatgacgagggacttgccaaaattacggaccggacagtccatatggtggatggtatgattaaaaaatattaattagagaacctaacttctaaaaatgtataccaaaaaggtagagccttgcaagtgttctatcttttagctatatatttatagtcgcttctctacggaagtctgtgaagatgatagtagagtgtttgttttgtttgtgtgtgatgcattcttgtctggtgtgataggaatgcatctttttttatttattataacaaatgtagggctcgatccgttcaagatcaataggagtgaactcctcataaagggataattgcttcagactttttaagattcctttctttttccgatattctatgatgaccttcgcttgatagtagtttatatatggatgacgcatcattcgttccataccggctttgtttaaattgatacggtgtatctgatgggtgtcaatagaaaaccacgggcggagtctttctacttttagatgaatctcctgtaactgctctatccggcaaaagccccccagccgttcgcggtaatttacgatcatccgggcaatattgcttccgactcccggaatctttttaagttcggtggtatcagcagagttgaggctgacgacagttcccgggaggtatttcacaagtgtgtcccgttgtatgctttgtacggttaataaccgtgttgtatctttatctttcgaactgaaatcttctgtaatttggatataaggatgaagagtctggtattgttcttctgtgagtccgtatatcttccgaaaatcctccggatggcggaatttgccttgtttatggcgatagtgcaggatattctttatcatccacgacggtaatccgagtgaaaggaaagtagtagagtccgcggtgttcggatcgaacatcgtaagcttgatttccctttgaggggttgatggaaaagaatgaccggactttgggtgaggttttgtttcccggagagaggaaataaagtcattatattcttgatcggctttctcattctctgtgcagtcggtatcttcggtacgagtgcaaaaggtaaagagttcaggagctgcatatactcctaaaataagaacgacaaggacgataatgccttgtcgttcggttttagtataataaaggaagtttttccacattatagcttgattagcccaagttcattgataaatatcagtgagatggcgattggtgcgatatattttaatataaagatgataagcttgtataccggtatctttaacgagccgtcattggtaatctctgaccatacaatctttttatccagataccatccggtaaagagggagatacacagtccgccaagtggtaacatgattttagctgttacaaagtcgaagagatcgaacattcccagtccgaaaacggtgaatcctttcatgactcccaatgataatgaacagaatattccgaggaagacacaaccgccggtgactaaccttgctgcttttccacgggaaagattaaactcctcgtgaagataagcggttactacttcatgcaaagaaatggtagaagttaaagcagccatcgccaacaatgcgtagaacattacagagaatatgtatgctagtacgggaactccgccaaatgcctgttggaatacattaggcagcgtgataaagatcagactgggacctgaatccggttgtatgccaaccgaaaaggctgccgggaagatgataaatccggctagtattgccacaaaagtatcaatgattcctacactgaaagctgttttagtcaggttggtttctttactgaaataagaggcgtaggtgcaaaggcatcccatacccagactcaaagagaagaaagcctgtcccatagcacttaaaaacacatttccgtccactttgctaaagtcgggtttgagcaggaattcaatacccgcaccagctcccggtagagtgaccgaacaaactaccagtatgaggataatgataaacaaggtaggcatcatgatcttcgaagacttttcaatccctttttctactcctttcacgataatgaaatgagtaatcaataaaaatgctaccagccatacgaccggtcgccatgggctactggagaattgttggaaagaagagataaactctccggagttttttccggcaaagccattggtggcagcctcaagaatatattcaagtgtccaccctgctactactgcataataactaagtatcaggaaacctgctaatactcccatgcgtcctacccaacgccaatgcgttcccggagctaatgtttgatacgctcttgcagtgttggctcttgatcggcgtcctatcaggaactcggcaatcataataggcaatcccaagagaaagatacaacctaaatagatcagtataaaagcggcacctccatgatttcctgtttcgtatggaaacctccatatattacccaacccaactgcagagccggcagaagcgagtatgacccctaatttgctgccgaagttcgctctatcaatttttgccataaatcttgttttatcttacaaatcgttataaaatatgcgagttaaagtgcaaatatagaaaatgatacttatatttgcacgaaaattgtaatattatttagatatgctatcttatattaagaaatatcctatctcgctttttatcattttgacagtgatttatctgtcgttctttaaaccgcctaagacggatttgaatgaaattcccaatttagacaaactggttcatgtttgtatgtatttcggtatgtcggggatgttgtggctggagtttttgcgtgcacatcgcagggatcatgctcccatgtggcatgcgtgggtaggggcattcctttgtccggtgcttttcagcggttgtgtggagttgctgcaggaatactgtactacttaccggggtggtgactggttggattttgcggccaatacaacaggggcgattctggctagtttagtggcctattatgtcgtacggccgaggatgaaaataaataaatagtaaaggcaacctatgaacaacaaaggtgaacgataagccgtgaacgatggcaaataataaacggtgaataatggatatgatatagtcaaccattattcaccgtttattatttatcatttgaagtttaccattccggttttatagaaattctaccgttgaactaagcttgatcccattggaacctttaataagaatggtatatcctttgggtttatcttcttgcaaatcctttataacttcctgcacatctgcataagttttaaaagaatgttcacttgtggcaaactgttctcccacgagccatactttctcaaaatcactttctttgatgtagtcaacgattttctgatgctcggccgggctatcagcacctagttcgcgcatatctcctaatatgagcatcttgtgagggactgtcatgttctggaagttttgcaaggcagccatcatgctggttgggtttgcgttgtatgcgtcaatgataagcgtgttatcttccgtctttttaagttgggaacggttgttctgtggcgtatactctgccagagcttcatcgatcttctttgcttccactccgaagaaacgtccgatagtgatggcagccagggcattcgggaaattatattctccgatcaactgtgtgcgaacctgatggcgttcaccgtccttaccggctttccattcgaaagcaagataaggcgaattgccggtaatccggccattgacatagagatcatcttctgttccataagaaatcaggttcagtccctgtgagatattcatcaaataggggttatcgtgatggataaaggtgatggcatctttcttgcggaggaaatcataaagctctcctttggtcttgataactccttcgaaagaaccgaatccctccagatgagctttgcctacgttagtgataataccataatccggttcggctatttcgcaaagaaacttgatttcccccggatggttggcgcccatctcaatgacggcaaggtcatgttccggttttaaccgtagcagggtagtcggtacgccgatgtggttgttgagattacctaaagtatagagtacattgtgggcttggcagagaacgctggaaattaactctttggtggttgtcttcccattagtgcccgtaatgccgatcactcgcgttccgagttggcggcgatgatagttggcaagctgctgcatggtttgcaggcagtcgtctacaagtatatatcgttggtcgccttctatggcatactgtatttcatcgataatggcaaacgcgcatccggagtccagcgctaatttggcaaatgcattaccgttgaacgactcacctttcaaggcgataaacaaagaaccgtccgggcagttccggctatcagtagttactgattggcaatccagaaaaatctggtaaagagcagaaagtttcataacctgatcttttatttaaaacgttgcaaagataggctattctttcggatttgatgggagttcggacagttttttgcttaggcgtatatcaaaggaagagtcaggatcatccggcatccttctgtataagaagtgtcgattcggagactacctcctaacttttcggcaatactccggcatattggaagtccgagcccggtgccctgcgtgaaagaattcattttgtagaaacgttcaaatactgcttcctgttggtctttcgggatgcctgttcctgtatcggtcacactgatttcaattttcttttcagcttccaatacggaataagcgatgcgaatactgccatgagtcgtaaatttagcggcattatgtgccaggttgttcaatacttgtgatatacgttccgaattactgcgtatgagcaggctttctctttcaggttcgaataaaacttctacatctttctgcgtgttatctttggcaacttcagatgcaagttgacagatcgcatgaaggtctgtttcggggtcagtgggcagttgttcgtattgatccagttcggacagcgtgagcacatcagtcaccagtcgaagcaagtcgttactgttgcttttgatgatattgacaaactcctgtgtttccggactattgctgtaatgatcgcttaatacctgcgagaagcctacgatagagttgagcggtgtgcggatttcgtgcgtcatgctctggataaatgttgttttcatccggctgcttgcctccgctatatctttggctttacgcaattcttccctcgataccataagctcttcattccttgttttaagttcggcttccgaaactttcagtttgcgtttcaggaagttttctctataaaggaatatgaataagatacctaataaaataatcaatgaaataatcaaggttgttttattatgcaactccttctcttgtgcctgaagcatgagttctttcttttcggcattgagtttttctacatttaataaggtggcgaattcgctgctggccacttgctcattggctattttcaaagagtcatccgtgttgatgtacatttgcagatatttgaccgccaggttcatattccccatcttttggtagatttctccttgtgtgcgataatggctgctgctaagtatgctttcgcttaaacgacgttcttctttttcctgcatctttgcggcttccagcgctttctgatattgtttggtctgctggtagtataaacattctatattatacagtctctttttgatagactccagtcttttgtcctgttcaaacgctgcctgacactccttcaataatttttcggcagcttgaaagtcgccgaacttgctgtaatagtttacaaattccaacttggcagatatttgttgcgtagaggaattggcagtcgcaatggctttttccacagcagccaatgcttctttttgctttttctggttgatgtaatagttggctatctgggcataagtctgggagatgttgtagttttcgatcttgtatttttcagtcagctcgatttctttcaatcgccactcgaacgccatcgaatcgaatcttttgatggtgtagatttgcgacatgatgttatagcaacgggagaggccggtcttatcatcctcttcttgagcttcttttaacatgttttgcacttcataaagtgctatgtttgttctgcttgtttttaggtaataggtaattaatctattagcccatgcgaagtaatagtatttaggctgatgagtggccttggcgaattcttttactttgttggtatagtggattacgctgtcttcattggttccttggaaataataataatccagttgagtggctatggctactgcctgcattcgttcgtcctgccgttcgccggccattcggaataaagtgtcggacatattaagtacaacaggctctaacaagtattcttgacaacgttgataatattcatagagagtagagtcaacattgaaagtttcagcctctttttgagctttagcagtagtggtaaagaacaaaatgaggaaaagaaatcctacgcgaaatagggttaatcggctcatggtatgaatttttcgggttcttctatagtttgcaaatatacgtttatttcttctttttagtacgaatacttgctttttttatctacatttgtaggcgatctaaaaggaatgttgtcaatgatgaaacctatatctcctatttgtataaatgtaaaagggcggttgcttgatcttgctactccgcaggtgatgggaattttaaatgttactcccgattctttttattccggcagccggatgcagactgaagaagacattgctgcccgggcccggcagatacttgatgaaggtgcttcaataattgatataggagcctattcttcacgaccgaatgccgaacatatttctgctgaagaagagatgcgaagactgcgcaccggtttggaaattttgaatcgtaatcatcccgaagccattatttccgttgatactttccgggctgatgtggcggaagaatgtgtgaaagaatatggagtggctattattaatgacatagctgccggtgaaatggatcaccggatgtttcagacagtagccgacttgggagtaccttatataatgatgcacatgcagggaactccccaaaatatgcagaaagaaccgtcttatgataatctgataaaagatgttttcctgtatttcgcccgtaaagtgcagcaacttcgcgacttgggagtgaaagatatcattctcgatccgggattcggattcggaaagacactggaacataattatgaactattggcacatctggaagagtttcatatcttcgaacttcccgttttagtgggagtttcgcggaaatcaatgatttataaattattgggaggaaccccgcaagattcattaaacgggacaaccgtattggacactgttgcgttaatgaaaggagcgcacatcctgcgtgtacatgatgtgcgtgaggcggtggaagctgtccggatcacagagaaattaaaaatagagagtggatatgacaaataagaggagggtgcatgttttttgagtttggtataaaagattttatcgatatcctgctggtagcttttgttttgtactatacctacaaactgatgaaagcttccggctccatcaaggtattcaccggaattttggtttttatcctgatctggctggtggtgacgcaagtgctggaaatgaaattgttgggctctattttcgacacattgatgaatgtgggtgtgatcgcgttgattgttctttttcaggatgagatacgccgtttcctcttgactttggggtctcaccgacatgtcagcgcactggcccgtctttttaacggttcgaaaaaagagtcgttgaagcatgacgatatcatgccggtggtaatggcttgtttgaatatggggaagcaaaaagtcggtgcattgattgtcatagagcataacgttcctttagatgaagttgtccgtacgggcgaactgattgatgcggcaatcaaccaacgtttaatcgaaaatatattcttcaagaatagtccgttgcacgatggcgcaatggtaatcagcaaaaaacgtatcaaggcggcaggatgtattcttcctgtatcccatgatttgaatataccgaaagaacttggcttgcgacatcgcgcagcaatgggaatctctcaacagtcggatgctcatgctattattgtttcggaagaaacaggcggtatctccgtagcctatcgcggacaattttatcttcgtctgaacgcggaagaattggaaagtctgctgacaaaagaaaactgattttatagtgataggccaatggtcaaataatgatggtcgttttatgactatcattatttgaccattggtgttttatttattatctttagggcaataacaatagatatgaactatccttttgtgacttaatggttatgtttctgccaggtatttctgcgatcgggaataaatgaaataaagcaaaatagcgccaattggcgctattttgctttatttctaaccctttttgaatgataattatcccctcctttttaggtgaatcgcctacctttgccgtatactattaaaattctatttttgaataaaccatgaaaaacaaaattattgctttactggtactttttacagttattctctttagtagtgcacaggcgcaaaccactgcccacaaatttgaggcgggcaagaacacattcctgcttgatggaaaaccatttgtagtgaaggcggctgaattgcattacacccgtatcccacaggcttactggagtcatcgcatagagatgtgcaaagcattgggaatgaatacgatttgcatttatattttctggaatatccacgaacaggaagaaggaaagttcgacttctccggtcagaatgatattgccgctttctgtaaacttgcgcagcaacatggaatgtacgtcattgtccgtcccggtccgtatgtgtgtgcggaatgggagatgggaggacttccctggtggctgttaaagaaaaaagacgtagctttgcgcacgcttgatccttattacatggaacgcgtaggcatttttatgaaagaagtcggcaaacaactggctccgttgcaagtggataaaggaggaaacattatcatggttcaggtggagaacgagtatggctcttacggaaccgataaaccatacgtttctgccgtacgtgatttggtacgtgaatccggttttaccgatgtgcctctgtttcaatgtgactggagcagtaactttaccaataacgcactcgacgatttgatttggactgtgaatttcggaactggggctaatatcgaccagcagtttaagaaactgaaagagcttcgtcccgaaactccattgatgtgtagtgagttctggagcggatggttcgaccattggggacggaaacacgaaacacgtcctgcgaaagacatggtacagggcatcaaggatatgctcgaccggaatatttctttcagtctctatatgactcacggagggacgactttcggtcattggggaggtgcaaacaacccggcttattccgctatgtgcagttcgtatgattatgacgctccgatcagtgaagccggatggactaccgaaaagtttttcttgcttcgcgatttattgaaaaactatctttcggcgggtgaatcattgcctgaaatccccgctgctttgcctgttattgagattccagaaattcatttcaataaagtggctccactattctcgaatttgccggaagccaaacaaatagtggatattcaaccgatggaacaattcaatcaaggatggggaactattctgtatcggaccacactgcctgaagcaatccccgcaggaaccgttttgaagattacggaagtgcacgactgggcgcaaatctatgccggcggcaaacttctggctcgtttggaccgtcgcaaaggagaatttactacgactttgcccgcactaaaaaaaggtacgcaactggatattctggtggaagcaatgggacgtgtcaactttgacaaatccattcacgaccgcaaaggtattacagaaaaggtggagctagtttcgggtaatcaggctaaggaattgaaaaactggactgtgtacaactttccagtagattattcttttattaaagacaagaaatataacgatacaaaaatactaccgtttatgcctgcttactacaagagcacttttaaactggataaagtaggagatacatttctggatatgagtacatggggtaaaggtatggtttgggtgaatggtcatgcaatggggcgtttctgggaaatcggtccgcaacagaccctctttatgccgggctgctggctgaaagaaggagagaatgaaattctcgtattggatttgaaaggtcctgccaaggcttctatcaaaggcttgaagaaacctattcttgatatgcttcgtgaaaaagctcccgaaacacaccgcaaggatggagaaaaactgaaactggcaggtgagaaagtaatacatgaaggtgctttcactccgggcaacggctggcaggaagtacgatttgctgctccagtgaaaggacgttatttctgtttggaagcgctttctccgcaagcaaatgataacatcgcagcagtggcagagttcgatgtcctgggagctgatggcaaaccggtatctcgtgagcattggaagattcgttatgccgatagcgaagaaacgcgtagcggcaaccgtacagccgacaaaatatttgatttgcaggaatctactttctggatgactgtggataatgtcccttatcctcatcaactggtgattgacttgagtaaagtggaaacagtgaccggcttccgctatctgccccgtgccgaaaaagaatatccgggcatgattaaagaatatcgggtgtatgtgaaatctgccgactttaattactaaactattgatgtacaagcattgaaatgataatagatatgaagaaaaatataatccttttcgcactcctcttcgtaggagtgttgactggatattgccaacaatctgcctacctgtttgtttatttcaccggcaatcgcatgagtgaagaagccgtcaggatggctgttagtctcgacggatataattataaagctttgaatggaaatcaaccggtacttgattcccgggtgattagttcaacaggcggagtgcgcgatcctcatattttacgttgtgaagatgggaagacattttatatggtagttacagacatggtatctgccaatggatggagttctaatcgcgccatggtattgctgaaatcgaaagaccttgtacactggacttccaatatcgtgaatatccagaagaaatatcccgatcaggaaaacctgaaacgtgtgtgggcgccacaaacgatttatgacaaggaagccggaaaatacatgatctattggtccatgcaacatggcaatggcccggacatcatttattatgcttatgctaacaaggatttcaccgatatagaaggagaaccgaaaccactgtttcttccgaaaaacgaaaagtcatgtattgacggcgacattatttataaagatggaatttatcacctgttctataaaacggaagggaatggaaatggcattaaaaaggctacttctccttctctgatctccggacagtggacggaatcagatgactataagcagcagacgaaggatgcagtagagggtgcgggtatctttccattgattggctcggataagtacatcttgatgtatgatgtgtatatgaaaggcaaataccagtttacggaaagtgtcgatctggaacacttcaaagtgattgaccatgctatcagtatggatttccatccacgccacggtactgttattccgattactcaaaaagaattgcaacgccttttcaaggcgtatggtaaaccggaaggtttctgatctaaaggaggaaggtcaaaacccatctaaattagaaatcatcctcgccacagcttcttgtcgcgaagatgatttcgttgaaaggaaatttgggcacctctcatctacaaattcaatgaatttcaagcgggtaattttcatttccagataaatacattcaccctttcgtctttttttgagttattaagataaggtggattcactagtgtaatccaggaaaatagtatacgatattggaaaaagtgtatattttacccttgtttacttgtttcttatatatttttaagtgtaaaacaaccaattatagcttgaaatatatcagttagaataatgaaaatcttaactttgcgattgataatcttaatgcaatagataccatgagaaatttattcctgtttttagttgtcttgtttttgtcgtttcagcaagtcactttagctgcaatcaaagaaatgacgagtacccccgattcggtttatctcttttcctttgccacttccggagacgacggacgtagcgggcttcgttttgcctggagcatggataaggaaaactggtttgaagtcggccggaactacggatatctccggtgtgattacagccgttggggatcacagaagaaaatgctcgacccttatttgaaacagtcgcccgctggcgaatggatatgtacctggaaattgaatgatcgtgatggatacggtcaggccacttctaaagacttgataaactggaccagccagaaatatccccgtactacttccgattttgacggaacaagagtgaaagccgtagttgccggagaggagcagaaaggaactatcaaccgggtagcgtggactttggtagatggattaaataagaactatggctggaatcaatatcggaactcattgcatgaagaacgtccggtgcaggatggagaacgttttgccggtttgaagcctgtaaatgcaatggtcaccgtacagcccgaacgtgccaaagacatcagcgatgtcttgttgggtgtcttctttgaagatattaattattcggcagacggaggactctatgcagagctgatccagaaccgtgatttcgaatacgacccttcagacagggaaggggataagaactggaatagtactcattcctggacattgaaaggagataaaaccactttcaccattaacactaccgatcctattcatgccaataatccacattatgccgtattgaatgtagaacgaccgggagccgcgttagaaaatacaggctttgatggtatcgcgctgaatgtcggagagaaatatgacttttccatatttgcgagggttccgcaggggcaatcaaacaaattgcaggttcgtttggtagatggagaaggaaatatatgtggagagacttctctgactgtatcttcccggcaatggaaaacgtataaaacagtgattactgccaaagcaaccgcagatactcgcctcgaaatcattccccaatctgctggagaattgaatctggatatgatttccctatttccgcagcatacatttaaaggacgcaagaacggactccgcaaggatctggctcaagtgttagctgacattcatccccgtttcatccgttttcccggtggctgtgtggctcatggtgatggtctgaagaatatctatcaatggaaaaacacagtcggtccgttagaagcaagaaaggcgcaacgtaacctttggggatatcatcaaagcatgggactgggatattttgaatatttccaattctgcgaagatattggcgcagaaccgcttccggtattggcagccggtgttccttgccagaactctgcctgtcacggtgacttgagaggcgggcagcaaggcggtatcccaatgagcgaaatgggtgcttatattcaggatattcttgatctgatagagtgggcaaacggcgacgctaagaagacaaagtggggaaaggtacgtgccgaagcaggccatccgaaaccttttaatctgaaatacattggcatcggaaatgaagatctcatcaccgatatcttcgaagaacgttttacaatgatatttaatgccatcaaagaaaaatatcctgaaatggtcgttgtaggtacagtaggaccgttcaatgaaggaacagactacgtagaaggatggaaactggccgacaaactgggtgtgccgatggtggacgaacattattatcagactccgggatggttcctgaacaatcaggatttctacgataaatacgaccgttcgaaaaagacaaaagtatacctgggcgaatatgcgactcatatcccgggacgaaaagcgaatatcgaaactgcactgacggaagctctttatcttgctgccttggaacgcaatggagacgttgtacacatgacttcctatgctcctcttctcgccaaagaaggacatacccaatggaatccggatttgatttacttcaataaccgggaagtgaaacctaccaccggatattatgtgcagaaactctacggacagaatgccggaaacgaatatttgccgtcgaagatcactttggataataaagacgataaagtgcagaaacgttttgcttcttccattgtccgcgattcggcaagtggagatgtgattgtaaagttggtcaacttacttccagtagaggttaatacccatgtcgacctttccggaatcggtgtgatacagccttctgcaaagagaaccgtactgaccggtaaaccggcagatactccgctacctgttgaagatacggtggaagtggcagaaaagtttgattgccaattgtctgcctactcttttacggtgatccggataaaaaaggcaaatgagaaataacaggaaataaatgaagaacataataacatgaataatatgaagaagataataagcactctactggtggctggttgctgtctgacttcgctgatggcacaagacgtggtcgtgaaaggaccggatgaaaaactgcaattggttgtctttacttctcctaccgaaaagccaagttattccattacctataatgggaaaaccatgctggagaaatcacctttgggtatgaacacgaatatcggtgactttgctaaaggaatgaaactgacagggcatacggtcaccccgattgatactgtctaccatcaggatcgtattaaaacctcacaagtgtattatcaggcaaacgagctgaactgtcattttgagaatccgaaagggcagaaaatagacgttgtctttcgtgtcagcaacaatgatgtagctttccgttatattctgccgcgtcaagatggaaaaggaagtgtaacggtgactgccgaagaaaccggtttccgttttccgcaacagactactactttcttgtgtccgcaaagcgatgctatgataggatggaagcgtacaaaacccagttatgaggaagaatacaaggcagatgctccgatgagtgaccgttcccagtacgggcatggttacacattcccttgcctgttccgtattggtgacgatggttgggtgctggttagcgagacaggagtggacagtcgatattgcggctcacgtttaagcgatgtgagcgaaggtaatctgtatacgattgctttcccgatggcagaagaaaataatggcaacggaacggttgctccggcatttgccttgccgggagctactccctggcgtaccatcactgtcggcgagactttgaaaccgattgtggaaacaactgttgcgtgggatgtcgtgcgtcctctttatgaaacaaaatatgactaccgtttcggacgcggcacatggagctggattctttggcaggatggtagtatcaactatgacgatcaggtgcgatatattgattttgctgcggcaatgggatatgagtatgcgttgattgataactggtgggatacgaacatcggtcgtgaccgcatgaagtctttggtagaatacgcacgtagtaaaggcgtggaactcttcttatggtatagctcttccggttattggaatgatattgagcaaggaccggttaatcacatggacaacgccattattcgcaaacgggagatgaaatggttacagagtcttggagtaaaaggcattaaagtcgatttctttggtggcgacaagcaagaaacgatgcgcctgtatgaagatatcttgagtgatgccgacgatcacggcctgatggtgatcttccacggttgtacaatccctcgcggatgggaacgcatgtatccgaattatgtaggtagtgaagccgtactggcatccgagaatatggtattcaaccagcatttctgcgataaagaggctttcaatgcttgtctgcatccgtttatccgcaatacggtgggtagcatggaatttggcggctgtttcctgaacaaacggctgaaccgcaacaatgacggaggaactacgcgtcgcactactgatatatttcaattagccactaccgtgttattccagaatccggtacagaactttgcacttgcccccaacaacctgaaagatgtttcccctgtttgcatggactatatgaaaacgattcctaccacgtgggatgagacgtgtttcattgacggatatccggggaaatatgtagtcttggcacgtcgtcacggtggcacttggtatgtggcggccattaatgcaggaaaagaaacattgaagttgaaactggatttagagatgtttgccggaaaaacagtttctctgtataaggatgataaaaaaggagcaccacagctagtgccgttgaaagtaaaagagaacggtaaagtacagctggagattcttccgcagggaggtgctgtattggtaaacaaatagatgatagttctaccgtttgttgtgggatcatgtggcaatgattgttcggtaaaagtttgatagaatcaatatttatagcataatttatgtagcactttttatgctacacaaattgtgctatgaataattgcttgaatataaacaatatagactgctttctttattctttgaatgaaatcatatttgagaaatgtttcgtggatataattcattcagttgtggttgcagacattgccttacgctggtatactaaaataatcatattcaagaaaagacccttcacctttcacaatgccctgttcatcgtcattagcgggtgaagggctggctttcaccttcctttcacctttctaccctggcttttacagctgtctagtctgctaaatcttttatctatagctggcaggagaagtattaatagatggcttccagactattataagaaaacttcttttctataagggacaaacttcctttgtataggacctaaacttcttttgcattataagaaaactataaatgcaagctttgattatataaatgcaagttccatttatataattgcaagttttgtttttataaacgcaactttcatttatagattgcatttattgaaaagtaagtttacatactggtagtaggaagtttacctataatcaaaagaaagtttgttattaatgaaagagagggtagttagtaatggataaggaagcaggtcaggtatgtcttcagaagcatagatagagaagtgccatataggattaggaaaccggactatcagaaaagcattttatgtgtatatataaatgacctgctcgaccagaaaatcactttgtgttgaaatcgggtaggttctttttattgagtgaactgataggtgaaatccctatccctatcgtattatatggtaaacgcaggctaaaattgaagtgcaaatgctccgtaatatgatacatttagcggagaatgattgttttttagtccttttttgacacataagtgtacctttatatttaatgtatcatctatctttgtaaacaagaaatcttatttaatatcatgaatatgaatagacattgcagaataatcaagtgtatattatcaggagtcgtttgcgcgttgttattgcctgtatcaatgcaggcacaaaagaacacagcatttatccccggacaagtgtggaatgatacggatggaaatccgatcaatgcccatggtggcggacttctttatcacaatggtacttactattggtatggtgaatacaagaaaggaaaaacgattttgccggactgggctacgtgggagtgttatcgtacagacgtgaccggagtcggttgttactcctctaaagacttgctgaattggaaatttgaaggaattgtgctttcggcagtcaaagacgatccgaatcatgacctgcatccctccaaggtgttggaacgtccgaaagtcatctttaataagaagaccggtaagtttgtaatgtgggcacatgtggaaagcgccgattacagtaaggcttgtgctggcgtggcggttgccgattctcctgtcggaccgttcgtctatcagggaagtttccgtccgaacaatgcgatgagccgcgaccagacagtttttgtggatgatgacggacgtgcttatcagttctattcttcggaaaataatgaaactatgtatattagtcttttgactgatgattacctgaaacccagcggacggtttactcgcaattttgtcaaagagtctcgtgaagctccggctgtgtttaaatataatggtaaatactatatgttaagctccggttgcacaggctgggatccgaatgtggccgaaatagcagtggccgattctattatgggaacgtggaaaacgatcggtaatccttgtacgggaccggatgcggataaaacgttttacgcgcagagtacttacgttcagcctgttatcggaaagaaggacgcatacatcgctatgttcgaccgctggaaaaagaaagacttggaagactcccgctatgtatggctgcctgtacttgtaaaagacggaaagataacaattccctggcatgaaaaatggactctttccatctttgacaaataaaaaagaagataagcatgaaacggatattactactactttgcggaataatacttgttcctactcttgtctgttcccagcgtttggtggaagtaggaaagggatatagctgtacttcggtcaatacgacggtctttcggaataactcgctggtgacgcacggtgaggaacaatatatcagttattacgataacgacggctatctgatacttggaaagcggaaactggattcgaaacaatggactttacaccgtacccaatatcagggaaatgtaaaggatgctcataatgtaatcagtatgatggtggatggagaaggttacatacacgtgtctttcgatcatcatggacataaactgaattattgccggagcattgctcccggttctctgaaactgggagataaaataccgatgaccggaattgatgaaggaaatgtaacctatccggagttttattctttatccggaggagatttactgtttgtttatcgttccggttcttccggtcgtggtaacttggtgatgaaccgttattcgctgaaagaacataaatggactcgtgtgcaggatatactgattgatggagaaaataaacggaatgcttattggcaaatgtatgtcgatgagaaaggaaccatccatctttcgtgggtgtggcgcgaaagctggcatgtggaaacaaaccatgatatatgttatgcccgttcgtttgataatggagtgacttggtataaatcaagcggagagcaatatgaacttcctatcaaattgtctaatgcagagtatgcctgtcgtttgcctcaaaactgtgagttgattaatcaaacaagtatgagtgccgatgcagaaggaaatccgtatatagccacttattggcgggatcccgacagtaacgtgccccaatatcgtatcgtctggaacgatgggaaagtatggcatcaacggcagatcacagatcgcaaaacaccttttaccttgaagggtggcggtacgaaaatgatacctattgcccgtccgcgtattgtggtagagggtggggaagtcttttatattttccgcgacgaagaacggggaagccgtgtctcaatggcacatgcgtccgacgtcggcattagtaaatggacgataacggatttgaccgacttttccgtggatgcctgggaaccgtcccatgatacggagctctggaagaaacagcggaaacttcacctttttgtgcaacacacccgtcagggagatggtgaacgtacagcggaaattgaccctcaaatggtatatgtattagaaacagatatgaatataaataagtaaagatatgaaggaattatctgcaactctttttttcgtactcttcctaggtggtgtaattcgtgtcttaattcatcatcaagctcatatatggctttaacggctggagtattttatctgttagttcgctaatattcatctgtatatgtgtaccgggcagtcgctcggtactatacatgcacttccctttacacagataataataaccgttattcacagacaattgcttatcagacaattccaattgcatttcatcttcggggaaagccgcggcatagatttgcagcacttctttggcattgatgatacgtgccatacccaacggatgttgaggctgttgatcttcgggaggtaagagttgaaccatgcgcttatatccggtgtgttgcctgatagcatacaataggctatattccacatctttatcttcagcgcaaagctcattgataatgatatgtttgtctcctttatatataatagtcatccccttgatttcgttttcttgtctggctacaaataagtatcctccgctgatggcaagatcagtcataataacctgaaagtcttccagcgtgtgctgaatacagcaagcccgttcggaaagcttcttattcaaataagaatagatctcctcctgaaactctgataccacactgaccgctatctctttagcaggaataaactccggcaaaacgatctctttagttgaatacttgaatacggaagcatatcccatgcgggcataatagtcgaacaaccagggctctgccggtatcaatgtactgaaatatactccattccgcagcatccgggcgaaagactgtgataagagctctcgcataacccctttgcttcggaaatcgggatgcgtacaggctcctgaaatataggaggtctgtacagtctctccaccaaaagtcatcggataaggaagcatctgaagcgcagagattacctcatcgccactttggatggcgacattcacctctgttttatagcgcagtctgaagtacatttcaacgaattcttcactatcgtcaaaacagattttccacaatgcttttacttgctcctttatcatcatatttataatggatttaccattttaccatattcatgggatgctctttgaggcaagccatatatttttccagaatcgttgccggctggtaagacagtttggctttgcgtaaaccctcaatacctaaatcctcttcccggttgatatagatatattgttcgggaatccggttggcaaattcataattaatcatggcatacgcaccttcaatactggtatccgctttttctacatgtacgccgaatgtttcatgattgataggcataccgaatgtgaatgcgacaattttaccgttcacatgcaagatacctcccgtcagtccgagtgcctcgaagttgtggagagcataaatcagggcgcgacgttcgttgcctgtcccctcctgttggtcacagttattcactttacaccactctgcttccagatccagacattcctgaatacggtccggggtaatcggtgtgtattcgtaatccggataagtgttgcggaaccggttgatatgatttcttttcgcttggaatttcttccctttcagcgtagatagatcacttctcaaataaatataatccgcatagtcgcggtcttctgtgaaagtgaactgttccggaaggatagcttcgagatcagcgcgcatattgctgcacactcccagcatacagaaatgctggttctctttgcgggcatcttctatcagttcccacaatactgctttcaaatctcctgtgcctacgggcatcatataagcaagttgttctcccgcccagaacttgaataccaaaaagttgtcgaccactgcgaattgagtgtcatataagaacctccaactgcaaagattggagaatgaaagatcgcaattgcggcgatcacttttcatcgtgaatgaggtgattgtgtctttgtctgctaatgtgatatctttaaatggaatcataaaattgctttttgcgtttaactctttatataacggaaaatcaagagattttgtttttacaagacacctaataatcgaaggattgtaggtgtgagcagtgcggtgaagattccattcagtgtcagtcccagactggcgtatgctccatatttgctgctgatatccattgcggtggaagttccgacagcatgagcggctgtccccatcgaaagcccttgggcgatcggactgcctacacgcatgattttcatggtcttaaaaccacagatcgctcctaataaacctactgccacaacaactgccgccgtcagtgacggaataccgccaatggctttggttacttccatcgcaatcggagtcgtaaccgatttgggagccagagacaggattacttcttgggaagctcccatgaacttcgcaatcagcactactgaaataactccgacaatgcagcctgccagttgagacagaaggataggcagtaactgcttttttatcatttccaattgaagatataaaggtacgcctaaagcaacaacagccgggcggagccagaactcgatcaaatgtcctcctttattataggtctcgtatgagatatttgtcattttaaggaagatgattaatagggcgatggtcagcaatataggatttaataataccagtcctgttttcttctgaagcaatttggcaaagaagaaaatcccgaaggtgatagccagcaggaagaaattattctctaagaagctcatttgtctttattcgttaagttgattttatctttaaggtgcagtttctccgacagatggaaatccgtcaggtgaagtttgcgcgccagcttaatctgacgtgccagcctgaacttgcggacgatttgatgtacccatcccgtaacgacaagtacaagcgcggtgctgataatggtcgctgtcactatcggccagaactctgccgcaatgacatcaaagtatagcataagagccacaccgggcggaacgaaaaagaatcctaagttggcaaccagaaagtcggacaatccctgtacccagtgtaacttaatccaacctaattttaaaaagagggtgagcagcagcataccgatgatgctggaggggagcttgatacccgtaagataaactattaattcacccaaagccaaacagccaaataaaatggcgcactgacgtatcataactaataacctattgattttgtttgaaaacgctgcaaaggtatgaaaaataggagtacagtgttaaatattacaatattttagacttggaagagaaaaataggcgaaattgtaatgtggatattgcaaaattgagtacttttgcaccgcaaattacaaattgtaaggacgttttataataatattcaatatatctatgctcaatttaatcaaccaaatcgtggcgcgtgcgaaagcaaatcgccaacgtattgttcttccggaaggaactgaagaacgcacattgaaagctgccaatatgattttgacagacgaagtagccgatctaattttactgggtaaaccggcagaaattaatgaacttgctgcaaaatggggattgggaaacatcggtaaagctactatcattgatcctgaaacttctccgaaacacgaagaatatgcgcagttgttgtgtgaacttcgtaaaaagaaggggatgactatcgaagaagcccgcaagttaacgaatgatcctttattctttggttgtttaatgattaagagcggtgatgctgacggtcagttggctggtgcccgtaacactactggtaatgtattgcgtcctgctttgcagattatcaagactgcgccgggaatcacttgcgtgtctggtgctatgttgcttttgactcatgctcctgaatacggaaagaatggcattttggtcatgggtgacgtggccgtaaccccggttcctgatgctaatcaattggcgcagattgcagtttgtacagcgcagactgccaaggcggttgccggtatcgaaaatccgaaagtagctatgttgagtttctctaccaaaggctctgctaaacatgaagtggtagacaaagtagtagaagcaactaaaatagctaaggaaatggctccgactcttgatttggacggtgaactgcaggcagatgcggctcttgttcctgaagtaggtgcaagcaaagctccgggttcggaggtagccggacaagcaaatgtactgattgttccgagcctggaagtaggtaacatttcttataagctagttcaacgtttgggacatgctgatgctatcggcccgatccttcagggtatcgcttgcccggtaaacgacttgtctcgtggttgttctattgaagatgtatatcgtatgattgctatcacggctaaccaggctattgctgcaaaggcaaataaataagtattagatataaagtagtaagtattaaatcgacaacgacatgaaaattctggtattgaactgcggaagttcatctattaaatataaattgttcgatatgaccagcaaagaagtgattgcgcaaggtggtatcgaaaaaatcggtctgaaaggatctttcttgaaactgactttaccgaatggtgaaaagaaaattctggaaaaagatattcctgaacatacagtaggagttgagtttatcctgaatacgttgattcaccccgaatatggcgctattaaatctttggatgaaatcaatgccgtaggtcaccgtatggtacacggaggcgagcgtttcagcgaatctgtattgctgaataaggaggtattggaagcctttacagcttgcaatgatctggctccgttgcacaatccggctaacttgaaaggtgtgaatgcagtttctgctattcttcctaacattccgcaggtaggtgtattcgatacggcttttcatcagaccatgccggattatgcctacatgtatgctattccttatgaattgtatgaaaagtatggtgtgcgtcgttatggcttccacggaacatctcatcgttacgtgtccaaacgtgtatgcgaattcttgggtgtaaatccggtaggaaagaaaatcatcacttgtcatattggtaatggtggttctattgccgctatcaaagatggtaaatgtatagatactactatgggcttgactccattggaaggcttgatgatgggtactcgcagcggtgacattgatgccggtgcagtgacgtttatcatggaaaaagaaggcttgaatactacgggtgtttccaacctgttgaacaagaagagcggtgtactcggtatttcaggtgtatcaagcgatatgcgtgaacttttggctgcttgtgcggctggcaatgagaaagctatccttgcagagaagatgtattattatcgtatcaagaaatacatcggtgcttatgctgctgcattgggcggtgtagatatcattctgtttacaggtggtgtaggtgaaaatcagatggaatgtcgccgtgaagtttgtaaggatatggaattcatgggtatcgagcttgacaacgatgtgaatgctaaagttcgtggtgaggaagcaattatttctactcctgcttctaaagtgaaagtagtagtgattccgacagacgaagaattgttgattgcgtccgatacaatggatattctgaagaagtaataactgaactgatttatattgtacggggatgtgccaagattgggacatccccgtctttttttgtattagttttacctcatggttcctttcatttacttccaagaaacaacattgttattattattgttatttgtagctaacaggtttgcttgttcttaaaaatacctgtatgtttattgtgtaattaaattaagtaatagtaacatgttaaaagtagtagcatttatgaggcaagtggctaatgggctacaaatggggggaaactttgggacggctcacgtatatcgtagtagtctcaatgccattattgtttattgtgggaaaggagatttcacttttgataaagtaactccgggatggttgaaaggcttcgaggtacatcttcgtagccgtggttgtagttggaatacagtttcaacttatttgcgcacatttcgtgcagtctataatcgtgcggtcgatcttcgaaaagcaccttatgtgccgaatttgttccattcggtttataccggtactcgcgctgaccgtaagcgagctttatgtgaggaagacataaaaaaggtatttgcaaaattacattcatcggttgcaactccggctttgcgatgtacacaagagctatttactctgatgtttttacttcgtggtttaccttttgtcgatctcgcatatttgcgtaagagtgatttgcatgataatgtgattacttatcgtaggcgtaagacggggcgtacattgtcggtgacattgactccggaggcaatgcttttggtgaagaagtacatgaattgtgacccttcttctccataccttttctcattgttgaaaagtcgtgaaggaacaaaagaagcatatcgagagtatcagttagcattgcgcacatttaatcggcaattaatgttgttgggtgaattgttgggactgggggataaattgagttcatacaccgcccgccatacatgggccacaacagcgtattattgtgaaattcatccgggcattatttccgaagcgatggggcattcgtccattacagtgacggagacttatctgaaaccttttcagaataagaaaatagatgaagcaaacaagcgggttattgattttatccgatattcagttcgaaatgcaatttgctgaatataagtctgttacttcgtaggtaacgggaataaataccggtgcaaatatgagcatatttcttaaaacaaccaaacgaaatcacacatttttttggttcttcgtcaaatttggtggtacttcttctattgtgaataaataatcttcgctctcagtagtttaattcctgccctattgtacatctgtctttttaccgctttaattttattcactgtcccctccagtaatccgttactgaaggtgcggtatgtatgatagaaaaggtcgaaaagaaaaaaagaaaggcagcataatctaactaaaataacaggaaaaacaggagaggttttaacttcccctaaaaaagacatgtacataatgcatgggtgggaaggaaaaaataagaatatgtaaacaatattctacaaaaaagatagaagactgggagagttgaacgaaaaaatcaagagaaaagctcacgtaaagcaaagcttttctcttgattttttagaaagaggaacatttactgaatatccctacctaattcttgaaatgctgataaataaggagataacagataaaagtataaagtaaaataaggtgaaaccgataaatcaatagtttatgttacttataaacttgtatcggcaattctcctttcaatgctcctatggcattaaaagctaacgactccatttcattctctcccggataaacatagatgggagccaggaaagagattctttttttcagccttgaaaccacatagtccgaataagcgattcctcctgtcaggaggatagcatctactttcccgcaaagtacagtagcactggcgcctatcgcttttgcaacattataaatcatggcgtccagtattaattccgcctttttatctccttcttctatcgattggatgatggcaggcacatcggtcgtacctaaatgagcagtcaatccggcacgtccggaaatacgtttcttcaattcgtctttggtatgctgaccgctaaaacaaaggtcgatcagttgaccggcaggaagtgtgccggcgcgttccggtgagaaagggccttcgccgtccaacgcattgttggcgtcgatggctcttccatggtgatggactgcgacagaaatacctcctcctaaatggcagatgattaaatccaactcttcgtattgcgtcccttgttctttggcgaaacgccgcgcgattgctttttggttcaaggcgtgccagatggtaattttcggcattaacggagaacctgtaatgcgggctatgtcttccagttcatccaccactcccggatcagcgatgaaagccgggcaatcgggtagggtggcggccagttcgctggcaatcagtcctcctaagttgcaggcatgggtacgcatggcatgcactgtatcacgtttcatggcatcgttcacctcatacactccgcccggtatcggtttcaccaaacctccgcgtccgatgattgcgtcaaaagaaaaaggaatcttgttattctccaattcttgtaataccagatttttgcggaattcaaactgatctattacctcgggaaaagcagacagctcttctacggaatgttttatattgctgataaataacggagtctcgttttcgtaaaccgcaatctttgtagaagttgagccggggttgataaccagtattttcatgaatggtgagttttaaatggtgaatttagaatgatgagttggtgacctgactggcctgttttctgcactcgcaatctcctgacacttgtaagcatgccatcgcaatgctataatatttggacaagccggaatcgctacgcgacggaagtactacaggacaaataggtccttgcagtaatcctgccatctctgcttttgcaaacagggagacagatttgtagaatgcattgcccgattcgatgttcgggaatatcagtacgtctgcctgtccgttgataggagatacaatccctttaatatcaccacttgcctgttcgcacgcagtacgtacatccagcgggccgtcaataatcacatttccgaattctcccgcttcggcaagctctacgatattcacataatctaatgaatgagggaacttggcactcactttttccgtacagtgaatcaatgcgacacgcggctgctcgatgccaaagtggcggcaggtacagatagcataccaaatcatctctatgcgttgttgtagcgtgggacgcggaatgaccgcagcatccgaaaagaaaagcagtttatgataagtaggaatttccatcactgccaaatgcgtgaggatttttcctttcggcaacaaccctttttctttgtcgagtatggcgtgcagtaagttgtctgtattgataatccctttcatcaaaatatcggctcccccttcgcgaacgatacggacagcctcgcgtgccgcttcgtccggattttcgatatggatagtttttacatattcgggatattgtttgagcgtgggatatttcttcagaattgtagaatctccaatcataagaaattctgcaattccctcttccagcgcacgagagatggcatactctgtgttaggatcgttggcacagaccacggcaattcgttttctatggtttagttttttgagatgggccgttagctgggcaaaatttagaataggttccataacgttagatttttagcaaatatcagaaaaatgattgaaaaaataacgattataacccgaaaaaatgcatccgttatgtaacattttgctatatttcatttgttttgactgttggatgtgcatggaaccgttttttcctgtatttttgcagatgaaaacaaatgcatccgggcagtctggtattttatcaacgaaagtcaattaaataagaatatatatggatattcaatttcctccctttttgcagaaaggtgataaagtggttattgtatcaccttcgagtaagatagaccaacaattcctgaaaggagccaagaaacggatagaatcatggggcttgaaagtggctatgggaaaatatgccggaagttcatccgggagatatgccggaacaatcaggcaacggctgaaagatttgcaggacgcgatggacgaccctgaggtgaaagctattctgtgtagtcgcggagggtacggggcggtacatttgattgataaaattgattttacggcttttcgtgaacatccgaaatggttactgggttttagcgatataacagcgttgcacaatctgtttcagaaaaatggatatgcttctctacattcgttgatggcccgtcatcttacggtagaaccggaagatgatctttgtacgaactatctgaaggatatcttatttgggaatatcccttcttatacgtgcgagaagcacaaactgaataagcaggggactgcacaaggcgttttgcatggtggtaatatggcggtagcatacggtttgcggggaactccatacgatattccggcagaagggacgatactgtttattgaagatgtcagcgaacgtccgcatgccatcgagcgtatgatgtataatttgaaattgggaggcgtgcttgaaaaactgtccggactgattatcggccaatttacggaatatgaagaagactgttcgttgggtaaggaattgtatgcagctttggcggatttagtaaaagagtatgattatccggtctgctttaattttccggtaggacacgtgactcataatctgccgcttataaatggcgcaaaagtggaacttgtggtcggaaagaaaaatgtggaactgaagtttatatgttaataaaccattccatctgaacgatgctgtgatgaaaataactaattttgaagccctaatagatgaaaggacgatgaaaaagaaaactatgatagtattaatgagtgcctttttgttattatcagcattctcttgcggaggaggtaataaggcaaatagtacgagtgaacaaagcgaagagacagcagtgaatgtacctcaatttgatgcggatagtgcttatttgtatgtaaagaatcaggtggatttcggacctcgtgttcctaatacaaaagaacatgttgcctgtggcaattaccttgccggtcagttggaggctttcggtgctcaagtgactaatcaatatgcagatttaattgcttatgacggaactctgttgaaagcgagaaacattatcggttcttataagccggaaagcaaaaaacgaatcgctctgtttgcgcactgggatacacgtccatgggctgataacgatcctgacgagaagaatcataatactccgattttgggtgccaatgatggtgccagtggtgtaggggctttattggaaatagctcgcttggtcaatcagcaacaaccggagttaggtatcgatattattttgctggatgcagaggattatggtgcgccgcagttctatacggggcagcataaagaggaattctggtgtctcggatcacagtattgggcacgcaatcctcatgtacagggatataatgcacgttttggcatcctgctcgatatggtgggcggtgaaggtagcgtgtttatgaaagagggatattctgaagaatttgctcccgatataaataagaaagtctggaaagcggcgaagaagattggcaacgggaagacgttcatggatggtaacggaggatttgttaccgacgaccatctgttcattaatcgcttggcacgtattaaaacaatcgatattattccatataatcaggagggtgactttactccgacatggcataccgtcaatgacaatatggagcatatagataagaatacgttgaaagcagtaggccagacggtattggaagtgatctataatgagaaataacaggattaaataattatttataatgtcaattaatgaattacaggacgaagtgattgcagaattcagtgacttcgacgattggatggaccgttatcaactacttattgacttaggaaatgagcaggaaccacttgaagaaaaatataagacggaacaaaatctgattgaaggatgccaaagtagggtgtggcttcaagcggatgatgtagatggtaaaatcgtttttaaagcggaaagtgatgctttgatagtcaaaggaattattgccttattgattaaagtcctttcaggacatactcctgatgaaatcttgaatacagatctttattttatagacaagattgggctgaaagagcatctgtcgccaacgcgtagcaatggtttgctgtcgatggtgaaacaaatacgaatgtatgcactagcattcaaagcaaaagaggggaagtgaaaaacttccctttttttatggttgctttctggaagtcagattgttcatggtcagtatggtgcagataagtagcaggattgaaccgaccagagtgacgagatacgggctaccgttaatcaggtcatccatattctcggcttcgggatatttgatgctaagatatacggatagcgagttgttgagcacgtgcatgagtatacaaggtatcaggctgcctgttttgtaataagtccatgccagcaggataccgatcagaaatgcgggaaggatctgggccggatttatatgaaagacgccgaacagaagcgcggaaatcagaatggctttagtcggattatattgttgaagtaaagctcgggtgattgctccgcgaaacaagatttcttcaagtacaggaccgatgatagctattgcaagaataccgccccaaccggattggagaatgtcgaaagattgctccatgatgttgggtatccagtctagcagtcccataagtgcagataccagaaagccagcggtgagaatagccagcccgctacaaattaggaatggcactgatacaggcgaccatgtcgctttctttttactgatatagccggctttccatagataaatacccatcataatctgaccggctaattgggccggaatcataatcatttgcgtcagggcaaccttatccaaatctcctgtggtgactaacaaatagatcgtacagggaatcataatcaggataggggcgacaatctgtgcaatgagaaggtctattaatatcagtttgatagccgttttcattggtctttagttagttgtaaagaaactatagataaacatagctaacatcgaaatagctattaccaccaaagagatgctcataaatgacttttgcataagaatctatttttaaattattattgttcggttattgtattatttattttgtttctctgctgttactgcctgccttgctggcaagaagaatagcttccgtctcttctgcatctttatggagttgcactattaactcgtcgatactggagaatttcagttcgggacgcgtccgttttacaaaagtaagccggatgaatttatcgtatatgtccgaatggaagtgaaggatattcacctcaatggtccggttagggccattatcaatcgtcgggcggacacctatgttcagcatccccatatatgtctttttatcaaatgtcacccatacggcatatacaccgtccgcggggatcagtttatcaggatcatccacgcttaaattggccgttggaaaaccaattttgcggcctacctgatagccgcctactactattccgtccaggaagtattcatatttcaggcaatcggcagccaagtccacttctccttgatgaagaagtttgcggatcagggaagaacttaccggaacgttgggtacgttctctatttctatattgctggtatatgctttggcgcgaatcacttctatgccaatttctttcccatagcgtacataatcctcgaagccctcgctgcggttgtgcccgaaacgatggtcatagccgataaccaggtattttacctgatagcgttcttttaacagctgtgtcatgaactcccgggcggtaagccgggaaacttccggggtgaaatcaagcatcaggcagtagtctaccccgatgtctgcaagcagacttattttttcttccggggtagtcagaagttccggacgataattcgtgttcatcactttgcggggatgaacggggaaagtaaccaatgcagagcgtagacctttggcggcggctatctctttcacttgctgaatcagatagcgatgtcctgcatgtactccatcaaaaaaaccgatggtagctacactgggttccgggttaatagccgatgtgtcacgtataatctgcatatctctaaaattatttgctgttgaaaagatggctccagtcttcgccttcttttgctgtataagtggaaattcctaaattctgggctgccttacagttcatctcggaatcatcgatgaagagtgtttctttcggctcgataccggcatcctctatgattgccttgaagatttccggttcgggcttggtcattttcatttcaaaagagaggtacgttttctcaaaatagtcttccaccttaaatgtgcggtagggaaacaggtgaatacatgtccagtcccaatggatttggttggtattgctcaataaatagacgacatatttctcacgtaattttaataataaatcaagtttgtgtgtcggtatgtctactaaaaaactattccaggctgcatctatttgtatgtcgctcactgctttgcctatcatctgccgaactccgtcacggaattcggcgggtgtaatcaatcctttttcctgttgcatcaggagtccgttcggattatggatgtccagtaggtcctccacgttccggagccctaatttctgaaagttctcaatgcaacgttggcggtcgagattgataagtacaccacccaaatcaataagaaggttttttattcctttacttttcatttctgttttttttgtgaataatacgttgaacaaggcgaataagttctccaacccataacaccgtggacgaaacgcctataataagaagccaggtttgccagttgagcggctccgtacggaatacagctccaccgaactgtacgatcaggaattgtccggcaagaatagccaatacaataagttccataccatacgatttggaaagtcccttgaatgccgaatcggtagtgccgaatacacgggcattgaacagattccagaattgcagcatgacaaagaaggtgaagaaaatggtcaggttgtgtatatccatacctttcgtgctgtggtcgaaataataaatcattccgagcagtacgatgaggaagatggagcccacacctaatatattagaccgcattgccttactgataataaaatcagtgcttcgacggggtttctcaagcattacggtttcgctggggggaatggaagcaagagccaaagcggcaaaagtgtccataatcaggttcacccataacatttgtgttacagtcagcggaagttccgtaccgatcacagaacctaacaagacaatgagcagtgctacgaagttgatcgtcagctggaaaacaatgaaacgctggatattcttatacagggagcggccccacataacagcagttccgatactgttgaaggagtcgtcgagcagggtaatatcgctggcctctttggctacagaagtacctgtacccattgataaacctacttgggcatgattcaaagccggagcgtcgttggttccgtctccggttacggctacgactgctcctttttgctgaagcagctgtaccagacgttgcttgtcagtcgggcgggcgcgggacatgatttttaaatccatcactctatccaatgcttcttcatcgctcaattcagcaaatgcaacaccggtgattcgatttcgttcggtatctgtttcggggttccaaagacctatctggcgtgcgatttccgttgcagttcccggagtatcaccggtcacgatcttgatgccgatacctgcggactggcatttagcaaccgcagcaggtacgtccggacgaatcgggtcggagatggcaactactcccaagaaattcaggtcgttggctgaaaccagttccgtacaatcgtttggctcattttctccgacaatcttgaatgcaaacccaagtgtacgcatagccatattctgatagcccaacagttgtgcttctactgtggaacgatattctacggcgtccactcgtcgtccgtccaagacaacttctttacacttgcccaaaacaatttccggggctccttttatatagagtattttttttccgatcagtggcgactcaacaagggttgccatgaatttccgttcggtagagaaagtgagttggtcgaggatatgtgctttctcgcgaagttccagataatttcttccctgcttgttaagccaaagcaataaagctacttcggtgggatttcctactcctttcggcttctcaccggtcgttgactcttcgaggaaagcggttgagttagcgctgattccttccgcaatgagtgtgctgatatcatcatcggacaaaacactgccatttttgatgccgtaaaaattaggctcgtgcacttgcatcaggttttgagtcagtgtaccggttttatccgtacaaatcacggtgatggctcccattgtttcgcaagcatgcattttccgcaccagattgttggtggaaagcatacgacgcatattcaatgccagactaagcgtaacgctcattggcaatccttcaggcacagctactacaatcagtgtaactgccatcataaaatatttcagtgtccgttcgaaaacaggaagccactcatgccatccgttcagtgaaccgaaatcaaagaataacaatacgtctttgacaaagaaaataaggaaagcgagaccggcaacggtaaaaccaatctttccgatgaggtttgcgagtttggtcaattgtatgttcagcggagtaggttcgagattgtcttccgtgctttgtcgggctactttcccgatttcagtagcatctcccacatgcagcacgcgcatggtgccatgaccgtccaccactgtcgttccacgcatcaccagattggaagcataagttgcctcttcatcaaagtcagcttctacagttgttttattaataacgggttcgcctgtcagattagattcgtttacttgcaaagagatggcttccagtaattctccgtcggcaggaatttcttcaccggtttccagaattacaatatcacctaccactatgtctttgcggggaatttcctgtacacgtccgtttcggatcacttttaccaatgtttcttcattgactgcattcagcagatcaaactttttgctggcatcatattcgaaaaagaaaccgattccggtggccagtaagatagctgctataattccgattgtttcagcgtattcgttctcgatgatggaaatgattaacgagaaaacggctgctactaacagtacgcgtacaaccgggtcttcaaatttttccagataaagtttccagagggaaggacgcttgggaggtgttaacaggttaataccatttttctccctgctttgtaggacttcgtcatccgtaagtcctaaatgataatagtcatttttatttgtactcatgcagatacatgcgtttagtttgaaccgcaaaaatacaacataaaattgtgataaattgtttaattaaaactttttatgaagtcgaatttgttatcgtggtttaccacatgtgcgataaggaattgtaaaccagaatgtagaaccttcaccttctacggaatctgcaccgatctgaccgcctagtttggcgacaatggtttgagaaatagagagtcccagtccggctcctttcttatctttgttcagtttcacaaagcgctcgaagacatccggtaatttctctgccggaattcctgctccggtatccttgacataaaagtagagttcggtatctcttgcttcatatccgatgcgaatactgccttcgtgggtgaacttaatggcgttgccggcaaagttggaaagcacctgtgccacccggttgcgatccgtttggatcatgcatgatgaacgagacggttctgctataatttgtatattttctccggcttcattgactctcatctggaaaagttgttgtaaatctgaaagcaatagattgacatccaccgttgtctgtacaaattccaaggttccggcttcgattttagacatatccagaatgtcgttgaccaattgcatcaggagatcagcattcatttttatgatttcctggtattgagccttttcctcttcggtatttgcgctgcctaacacttctgcaaatccggtaatagcgttgagaggagtacggatctcatggctcatattagctaaaaaggccgattttgaaatatccgctttttcagctttttctttggctagtctcaattcattttcggcctgtttccgtcgggtgacgtcatgtacggtgataaccatattctcttcttcattgagaaggaagtaggagccggatattactgcgtcacattccacagttgtattatcagacgtgactacggataaagttgcttcgagatccgtgaagttccgtctctgttcgaaggcctgacgtatggcggtacgtatcggacaggaaccgcagaaactatgtgtgccgcagcctccttcggcagccaatgcgttacggcattgcaacaggtcgcccactcttttttcctctgttccttttctggttccggttttttggtaatagttggtcttcagtactttaaaatcgttatctattagcagaataaaagcatgtacattctttaaaacggcaccggcgatatggctggtacgttccaactttctggattcacggaacaatcgttgttgcatccgtaggcatttcctgcgttcccataaaaaactgattagtaggactgcgcataaaactattaaagttgacaatagtgctataagcatagtataatattgttgttttagcttgataatatgactacaaagatagcttttttctttagtttggaaaatagtgttgaacaaatatccagctatttgtgttatattattcagaaaaccatttaaaaatacgaacgttatgaaaaagtacatttgcacggtctgtgaatatatttacgaccccgaacaaggagatccggaaagcggaattgaaccaggaacagcctttgaagacattccagatgattggacttgtccgttatgcggagtcggcaaagaagattttgaaccgtacgaaggataaaaccaagagagagagaattatttaagaggagaatggccgggtgtatagatatatgcccggtcttttttgtttttctggaggatgatttaaattaaaaaggagaatcagtaatgctatgatagactgattctccttttttaggattcaattttgctctatcaagaagcttttttctcttttacatcactactggcttctactacattcaccacatagtcacctagtttttcacattcggcgataatatccatgtaataaactcccatctgataatcgtattctttgttgtttacgtccagaatgttctgattcttcagttggttacggtagttgttaatttcattctcgatgttgaaggacttattgatgtcaatgttctgatgttccggtttttctacaaccacaatcatttgagcaagtgcgtcgttggtcagcttcatcatgaggtggatatgttcatattgtttctcggtaaagtcctggttggtttggcgtttccggttgatggtacgtgccaggttataacagctgtcaccgatactttcaatttccgtcacttcacgcaacatggcacgtatctgtagtttactttcagaacttaaccggccttcagatacttgattcaggtagttggctatttcaagttccatgttgtcgctgatattttcatacttctcgatccggctgaacagcttgttgaaatcgtcatccttttctgtgtgtagcaaatcctgcaccatgccgaacatccggtgtgtacgttctgcaaaaagatggatttctttgcgtgcctgaaggatagaaagttcagcggtagaaagcataccaccggtgataaaccgcaaacggggctcttcgtcctcttctttggggtggataagagcacatacggtacgttcaatcagtttaaccgcccatatcagaatacatacgttacagatattgaaaattgagtggaaagccgataacttgtaggagatggcaacttccggattgttactttggaaaaaggtatctactacccagtttaccagttccatgaaaggatggaagacaatcaagacccagataacaccgaacacgttaaaaacaaaatgggccaatgctgcccgcttagcctgtgtattggctgtaagtgcggcaagattggccgtgatagtggttccgatgttttctcccaaaacaagtgctgctcccagttccagactgatccagccgttggcgcacataatcaatgtaattgccatggtggcggcggaggcctgtacaatcatcgtcaatatagtaccgatgagtaagaacagaatgatggagaagaatcccatgtccgtgtagttctgtacgaaggcaagcatttccgggttggcgttcaggtcgggcgcgtttgctttcagataagaaagccccatgaaaaggaaagaaaaaccgaaaatgaattcaccgatggacttgcggttgcttttgccggagaagatgagcggaagggcgatggctaagagcgggagagcgaaggcagccatatcaaccttaaatccgaaaattgaaatgatccaggcagtcacggtagtaccgatattagcacccataatgacgctgatggattcggcaagtgtgagcaatccggcgtttacgaaacttacgaccatcactgtcgttgctgaagaagactggataagagctgttatcaacactcctgttaaaactcccgttacccgattggtagtcattgccgttagaatacttcgcaatctgtcacccgcgaccttttgtaagccctcgctcataatcttcattccgtaaaggaagagtcctaatgagcctatgagctttaaaaaatcataaaaagaatattccatctataatatttttaatggttatttgttctctatctgattataagtatattagtcccaaattattcaccttttaacgaactcgatgaaacagatgttacaaatatgttgcaaaaataacaatatttccaaagaattccctatcggaagctcacttttggatatttattacggttttaatcttaattttccttatcaagtagtaagtgccaaggtcaataatcgttccgagggactgaatttcagagtttataataataaagatgtagagtttctggatgtgagagatcagtccggtatgcgtacgtatgtccgttcgctttgttttgtcttgtttaaggctgtcacggaactgtttcccgacggaaaattgtttgtagaacatcctgtttcaaaaggctatttctgcaatttgcggattggccgtcccatcgaactggaagatgtgacacgcatcaagcaacggatgcaggagattatcgcggagaatatttcctatcatcgcatcgaatgtcatacggctgaagctgtgcgtgttttcagcgaacggggaatgaatgataaagtgagattgctggaaacttccggttcgctctatacctattattatacattgggtgataccattgattattattatgggaatctgctgcccagtaccggatatcttaaattattcgatatcgtgaaatattacgatggattgcttctccggattccgagccgggaaaacccgaatgtgcttgaagatgtggtgaagcaggaaaaaatgctggatgtctttaaagaatatctgaactggagttatatcatggggcttaacaatgccggagattttaatctggcctgtgaagagggacatgcaaccgatctgataaatgttgcagaagcactgcaggagaagaaaatagcccagatagccgataccatattccatcgtggtgaaaacggtaaccgggtaaaactggtattgattgccggaccatcttcttcgggaaagacaactttcagcaaacggctttctatccagctaatgaccaatggactgaaaccattcccgatctctttagataattactttgtggatcgtgaagagactcctctggatgaaaacggaaattatgattatgaatcactgtatgcacttgatttggaattgttcaaccaacagttgcaggcactcttgcgcggtgaagaggtcgaactgcctcgttttaatttctctcttggcaagaaggagtataaaggcgataaactgaaaatagaagataatacaattctgattctggaaggtattcatgccctgaacccggaactgacaccacatataccggctgaacggaaattcaagatttatgtttcagcattaaccaccatctctttggatgaccataactggattccgacaactgataaccgtctgttgcggcgtattatccgtgacttcaattatcggggatattcggctcgtgaaacgatatcacgctggccgagtgtacgtgccggtgaagataaatggatttttccctatcaggagaatgccgacgtaatgtttaattcagcgttgctttttgagtttgcagtactccgtttgcatgccgaacctattctgatgggtgtcccgcgcaactgtcctgaatattgcgaagcataccgattacttaagtttatcaaatattttgttcctgtacaggataaggagattccgcctacgtccttactgcgcgaatttttgggaggtagtagctttaaatattaagtagaaaaattaggatatattcgttatttgtactttctttgcagaaaatatgaattaccttttgttgtagtaaggcaagagaacacaaaataaacaatatttgaataggattctttaggggagaatactgtataatgactgttatactaaactataatattgaacctttggttacttttgctgttataaaaggactacatgcaacaaaaaaaatgtgaatatgattttttataatagtcttttagcaaagtggttcttgggaaaaggaaagaaacactattttatgttaggctggtttttctttacccggtataaatatctggaagtttgggaagatatggagttacggatacatgcaaagcaatattgggaatgcttttctctgactctgataccagcgttgattttgtcattactgttttcatggtggtgtatgatactaccattcataacttatgacctcctttattggtttgaaaagatcatctaccaccattcaatatttaattgggaggcgataaagcatagcggcgatacgctttatctccgaaagagaaaagcgtatgcctggaagaaaggttacgggaaaaaagagttgcccgtatccagatggaatgattgattctttatttcaaatgcttctttatccaaagcagatgtccatactccgtatcgttggaggtccaatgctcattaataggagtaatcagggcttctttcggacagtttagtacattgtatactatatagctggtagtcggaggacatacatcgtcattgaatccccatgttatataggtgtctgcttttatcaatttagcaaagttcactacatcataataggccattgtctttattttttcgggggtatccatatccaccgaatttctaaagaaatgaggatagccaccggcacgtccggctttatagcctgccatatcgcttaatgcaggatgattggcgacacaaactgtcacccgttcatccagtccggcagcgattaatgccagggcgcctccctgactacctccttgtgcgattacatttttgccatcccattccggcagggaagtcagaaagtcgataccgcgtacacaggccagatatacccgtttcatataataattatcacgactgtcgagcccgttggtcagatagccgttttctctgctattgaaagcgttgctgatttctttaaattcttcatcagtcatttccggattcaggccgtgtatctcgaattcaaaacggatgtatccttgctccgcataatatttatggcgtagaggttctttgatagttttgatgcctgctcccggagggcacaggacaaccggaaactttccttcttttttcggatagaataaatatccgtagacgcattgcccacgtttgttcagttgcaattttacgagataacagtctattttatcagtggaatatttttcgacatgttctttggtatacgttaggggaaattccttttgttctgcttttgccttttcccaaaattccttgaaatcggaaggcatggttgtatacggacgaagtttttccggtgaaaatcctactttgatatgatgtgaataggtctttccatctacggttgctttcagacgacagtcgcggaatcccggctctttcattgtgcccacaggaatcactcccctgccattctttaaagttacacttcctttggtatcggcaacaggcatcatatcaccacctatttcataagtgacggttacgttatctctggggataccgtatttatagaattgtacctccacagttgctttttctcccgttttataaagccagtcggcatgattgggtacggtgacccaaagcacatcgcttttataaggatagttttcagctacggcggacagcaaggtaagtgacaatagccatacagataaaagtagtcttttcatggtgttattcattgtttttatatcattaaaaagtgagttgttttaattctgttgcaatattacgcaagatttgggaaaaggagggtagaaaaaatgtgcttttagatggactatttggtactttgacaaaaatagcagaagtatttcactcggatgaaaaacttccgctattgattttgaatagaagaaaggttcttcttttattttgatgaggcttttatttttatgaagctttttatcttaacgcttccacctcttccggtgtcaaagggatcttcttacctaatcggcgggcgccggtttctgtaatcagataatcttcctcattgcggataccaccgaagtccttataagtttccactacatcataattgatgaaatcggtaaatttcttttctcctttccacatgtcaatcagttccggaataaaataaatacccggttctaccgtgtgtacaaatcccggttccaacggaatggcgagacgttgcgatttgcgaccgaactgtgtgctcttcggttggccgttatatcctacccatatctctcccagattttccatatcgtgtacatccaatcccatcatgtgacctaatccgtgaggatagaataacgcatgagcaccttcgcggaccgcatcttccgtatttcctttcatcaatccgagtgccttcataccgtctaccatgacacgggcagacagttcgtatacgtccatataaggaatacccggacggagggcttttacagattccagatgcatcgcattctgaatctcgtatacttcgcgctggcgggctgtaaactttttgtcggcaggaatggtagacgacatatcgcctgcatagcctgattctacttctgcgcctgcatcaattaggaataaatcacccggttttactttatttccatgatagtggttgtgtaaagtctgtccgttgatagtggcaatggtggcaaaagaaagctggcagttgttagattcggccacccggttcatttccgctaccacttcgtattcatacatgcccggacggagcactttcatggcggtgatgtgcatatcggcagttacatcgcaagccttctctatttctacaatttcttcggcagatttgtaattacgttgggcgataacggcacggatgaatggaacagaaccttcctgacgtgtagggggaatacccaaccaatccatcagtttcaatttatgctcgggacggtaaggcggcagataatgaaccgctttccctttctggacgcacttgtggagatagcttgtaatttctgcggacggcatcagattttttacgcccacacgttcgcatttttcgtgtaatgtaggttgcgatcccatccatacgattgcgtcgatagacagttcatctccaaaaatgatttctttgtcttcatcaatatcgataatagccgaaaggccggcgcatgaaagtccgaaataataaaggaaagtagaatcctgacgataacggaaggtgttatcctcgtagttcagtccgcactcgtcatttccgagaaataacaataccccggagcctaaattcttttttagcagggctcttcgctgcatatacgtttctttggcaaacatattgtcctaatttttaagttcgtgcaacaaagataacgaattttgtgttataggattaaaaattatctccttaatctgtgtaatctctcgttaaaaagttacttttgtagcgagaaatagtagaaagcaaaaacgaatatggcacaaggttcccgtcaaatacaatctcaggcgcaacagcaggtacaaacgctctcgccccagcagattctggtcgtgaaactgttggagcttcccgcagtagagctggaagaccgtatccatgctgaactgcttgaaaatccggcacttgaagaaggcaaagaagaaaacactgcggatgagtatgctgattccgacactacggaagatggcatgaatagcgatgccaacgattatgattctttgagtgattatctgactgaagacgatattcccgattataaattacaagaaaacaaccgttcgaaagatgaacaggcggaggatattccgttctccgattccacttctttttatgaaatcctgaaagaacagctgcgtgaacgcaacctgactgaacatcagtgtgacctggtggaatatctgatcggttcattggacgatgacggactgctccgtaagtcattggagagcatctgtgatgaactggcgatttatgccggcatcgaatcgacagaagaagaattggaggaagcactctgtatcttgcaggactttgatcccgctggtatcggtgcccgtagccttcaggaatgtctgttgatacagatttgccggaagaaggatgaagagaagaagcccaacccgatactggagctggaagaacgtatcatcagagagtgttatgaagaattcacccgtaaacactgggagaagattataaagaaactggacattgatgaagagactttccaggaagctcttaatgagataaccaagctgaatccccgtccgggtgcttctttgggagaagcgatcggcaggaatctccaacagatagttcccgactttatcgtggaaacgtatgatgacggaaccatcaatataagcctcaataaccgtaatgtccccgaactccgtatgagtcgcgacttcacggaaatggtggaagagcataccaaaaacagggctaatcaatcaaaagaatccaaagaagcgatgatgttcctgaagcagaaaatggatgcggcacaaggatttatcgatgctgtgcggcagcgtcagaataccctgatgactaccatgcaggctatcattgacttacaacgtcctttcttcttggaaggagacgaatctctgttgaaaccgatgattttaaaagatgtggccgaacgtaccggactggacatttcaacgatctcccgcgtgagcaacagtaaatatgtgcagacaaattacggcatctatccgctcaaattcttttttagcgacgggtataccacagaggacggcgaagaaatgtctgtccgcgagatacgcaagattctgaaagagtgtattgatggggaggacaagaagaaaccgctgacagatgatgaattggcagacatcttgaaagagaaaggttatcccattgctcgtagaacggtagccaaataccgtcagcagttgaatattccggttgcgcgacttcgaaaatgagaacgaatataaagtattaagtataaagtattaagtattagtgctgatggacagagagagagaacatatcatagcggataagacaatgttgcaggtggcgagagctacttcgatggtctttactccattttctattccgtttttatcgtttctggtgttattcctgttttcttatcttcgtatcatgccgatacaatataagttgatcgtgttgggaattgtttactgctttaccatactgacacctaccattaccattttcctgtttcgtaaaatcaatggctttgcccgtcaggagttgagtgagcgcaagaaacgttatgtaccgattctgctgactattatctcgtatgtgttctgcctgttgatgatgcgtcggctgaatataccttggtatatgacaggtatcatcctcgtttctttggtagtatctattatctgcattgcagtgaacttaaaatggaaattgagtgaacacatggcaggaataggcggagtgatcggcggattggtttctttcagtgctttgttcggttacaatccggtcggatggttatgcctgtttatattgattgccggtatattaggttctgcacgaattgtattgggacatcacacgttgggtgaggtgctttccggttttgcggttggcttgatatgtgcccttttggtacttcatccggtgagcaacatcttatttcgagtatttttattttaaaacagtataaatcctaaaaactaattattatgaactttccacagaatttgaagtacacgaacgaacacgaatggattcgcgttgaaggagacattgcatacgtaggtatcactgattatgctcaagaacaattgggtgatatcgtgttcgtagatataccgactgttggtgaaacgttggaagccggtgagacattcggaaccatcgaagtagtgaaaacaatttccgatcttttcctgcctgtagcaggtgaggtgctcgaacaaaacgaggcattggaagaaaatccggaactggttaataaagatccgtatggcgaaggttggttgattaaagtgaaaccgacagatataaaagctgtggaagacctgctggatgccgaagcatacaaagcagtagtgaatggataaggttttctccattacatcaatcgaataatgtaaaagatactataatccgaagccagccttaccctctcttttggggagagggttgagaagtggctctttaatttttatcctatgactccaattgtaagtattatcatgggtagcacgtccgaccttcctgttatggagaaggctgcgcaattgctgaatgatatgcatgtaccgttcgaaatgaacgcgctttctgctcaccgcacgcctgaagctgtggaagagtttgcaaagaatgcccgcaaccgtggcattaaagttattatcgccgctgccggaatggctgccgcccttcccggtgtaattgcagccaacactacactgccggtgatcggagtacccgtaaaaggttccgtgctcgatggtgtagacgcactttattctatcatccagatgcctccgggcattcctgtggcaacggttgctataaacggagcgatgaatgccgctatccttgccattcagatgttggcattgagtgacgagaaattggcagaagcttttgctgcttacaaagaaggactgaaaaagaaaatcgtaaaagcaaacgaagaactgaaagaagttaagtttgaatataaaacaaactaatgtgatttacgatttgacaatttacgattgacgattgaaatatcttcgtaaatcgtatgttgtctttgcacattgtctttgcatattgcgcagaaagtgttttcagtcatcaaatcataaatcgtaaatcataaatcataaatcaaaatggttgatctattcaattattttcgaagagaaaccacagaagtaaatattggggctgtaccgttgggcggccccaattctattcgtgtccagtcgatgaccaatacgtctacgcaggacacgcaggcttgtgtggaacaggcgaaacgtattgttgacgcaggtggcgagtatgtccgccttacaacgcagggtatcaaggaagcggagaatctgatgaatatcaatatcggactacgcagtcagggatatatggttccattggttgccgatgtgcatttcaatccgaaagtggcggatgtagctgctcaatatgcggaaaaggtgcgcatcaatccgggaaactatgtagatgctgcgcgtacttttaagaaactggaatatacagacgaggagtatgcgcaggaaatacagaaaatccatgaccggtttgtcccgttcctgaatatctgtaaggagaatcacactgcgatccggattggtgtgaatcatggttctttgtccgatcgcatcatgtcacgctatggtgatactcccgaaggaatggtggaatcctgtatggaattccttcgtatctgtgtagcggagaacttcacagatgtggtgatttccatcaaagcctccaataccgtggtaatggtgaaaaccgttcgtctgttggtggacgtcatggaaaaagaggggatgactttcccactacacctcggagtgacagaagccggagacggagaggacgggcgtatcaagtcggctctcggcatcggagcattgttgagcgacgggttgggcgataccatccgcgtatctttgagtgaagcacccgaagctgaaattccggtggcccgtaaattggtggattatgttctgttgaggcaggatcatgcctatattccgggattggaggcgcctgaattcaactatctgtctcctgaacgccgtaagacaaaagcggtccgtaatatcggaggtgaacatgtgcccgtagtcattgccgaccgcatggacggaaagacagaagtaaatccgcaattcactccggactatatttatgccggaagagccttgcccgagcaacgggaagaaggcgtggaatatattcttgatgcggacgtatggcaaggagaggccggaacctggcctgctttcaatcatgcgcaactaccgttgatgggggaatgtgatgcagcgcttaaattcctgtttataccctatatggcccaaacagatgaagtgatagcctgtctgaagtaccacccggaagtggtaatcatctctcaaagcaaccatccgaaccgtttgggtgagcaccgtgcattggtgcatcagctaatgacggaaggtttgcagaatccggttgtcttcttccagcattatgcggaagatgatgcggagaatttgcagataaaatctgcagccgatatgggagccttgatctttgacggtctttgcgatggtatcttcctgttcaatcagggcagtttgagccatgccgttgtcgacgctactgctttcggaatcttgcaggccgggcgtacccgtacctctaagacagaatacatatcctgtcccggttgcggccgtacgctttacgacttggagaaaacaatcgcccgtatcaaggcagccacttcacatttgaaaggcttgaagattggcattatgggctgtatcgtgaatggtcccggtgagatggcggatgctgactacggttatgtaggagcaggacggggcaaaatcagtctttataaaggcaaggtgtgtgtagaaaagaatattcctgaagaagaggcggtagaacgactcctggagtttatccggacagatcgggaagaaaaccaacaatgataattgggcacggaatacaggtgatggggactgatctcatagaaaacctgtcatccgtgcctaactttcatgatgaggattctacggcgaccggtaacgagtgccattcttgaactttcctcaaatgccaattgctgaattcgttttagctcttttagttcttcttctctattataaaacctcatagtcagtgaattatattagtaactgtggttactgtaaccacggttacaaagatgtttattctgaagggaacagcaaactttttctttcttttataaattctttaccctttccaattaaaaattttatgatcgtttctattgatttgtaccagtcttattgtcaaactgtcaggatgatatttaagtatttgaatagcagtgttatatcacctgacgatagatgttgataataggctgacaataaaatatatctacttttactgtcagccttatttttatctcttatgatccttttatgacttgataaataatagtcttagaagcatgttctgaagtaatgttgcattttaataacagcctcccaaagtgatatctacctatatagttccattaacgtgcctatgtagttgccctagagtgtcagtatagttctactgaagtaccgctatctttactttgtcacggccgtggtgacttcttcccacagccgtgacgagttcctaccacggccgtggaaagatctcgtcacggccgtggagagttaacaatactgatgctttaatgtaacaatacctacttgttaagtgaaagataccagctatatatcattcatttaatagggggattcattttaaaaagctgctttctatgtggatggtatggttactgcaggcgatgatgtccttcgggtgcatcctgccccaaagcaatcaaagaacaggctgacaataaaagttctaattttttattgtcagcctattgtcatggcttattgtcagcatgtaaaccgatgataatcattatactatcgggtaaaaactttggttgacaataagaatcattaaatttatacgtagacttaatatctgtctttccaatagtacacatctttacaaaaatagaggggaacttctggatgaatccatttgttcccctcgagggtattgctagcctttacctcttatattttcaaaggcaagtagcaacatctaaatgttacgttttcgactttgcagtcgttcgggtgtcgctccatccgaattgacttgcctttgtggttattattaacttgttgttttacatctaccgcaaatttataggcacaaaaaaagcggagagcatttgcctatccgccagagagggagtccaagccctaaacacacaaacaggaaacactccccgcatattgcaaggagcatttatctgcttctctgtgtgtttggaatttttggacttttcactggcacagaaatcagctaaacgcttttttttcttaaaacaaacaatacagtcgcgctacgactgattgtgcaaagataacaattaattaagttatacagtctttcatcctatgtttttttctctgtgcagagtgtttttgttctatgttccataaaatcgtttgaaatagtctggttcccttgctatgactatatctcataagattcatatcgtttattttatatattttcactaaacctctcggagttatgcgaattattgttatttttgcctcacataatttctaaacaataattaaattatttattcgtatgaaaaaggccttgttattgttcgctctagtagcgataagcgtagtgagtatcaatgctcaagacaacctgaaatggggtgtgatggcaggtatgaatgttagtaaatacaccattacaggttttgacagcaggataggttttcacgcaggagttaaagcagaagtgggattgtcgcaggatgcgaatggtagtggtgcctatatggatttcgctgcattgttgacattgaaaggtgctaaagttgatggcggatcacttgcaagcataacatttaatccatactatctggaagtaccagtacgtgtaggatataaatatgcagtgaatgatgatttctcattatttggtagtgtaggtccttatattgctgtcggactgtttggaaaagcaaaagcgaaagtggacggtgattattttgattttgatgaaataggaggcaattcagcatccgaagatatatttggcgacgatgggctgaaacgtttcgatttcggtcttggactgaaagccggagttgagttcagtaagaaatatcaggttgccataagctatgatttcggacttgttgaggtaatcaaagaagtaggaatgaagaacagaaacctgatgatctcattgggatatatgttctaaaaccgattttgcaactttgttgcataaatcatttgctacctttgcatcaactaaatgatgaatgttatgggacattgtagttgtggcgctcactcatgcgcaacagaaaaaaaggttgatgcaaaggtttcgaacttccatgaatatgggaaagtgatattctctctcttgctgctggcaggtggaataatcatgaatgctcttgatttagcattcttccgtgaaggatatgtttctttaatatggtatatcgtagcctatcttccggtaggaattccggtgatgaaagaagcctgggaaagcatcagggaaaaagactatttcagtgagtttactctaatgactattgctactctgggggctttctatattggcgaatatccggaaggagtagccgtgatgttattttatacagtaggagaactgtttcaggataaagctgtagataaagccaaacgtaatatcggagccttattagacgtaagacccgaaaaagcactggtacttagagagggtaatcttgttactgaaagtcctaaaaagataaaagtcggtgaaatcatagaaataaaggcaggtgaacgggtgccactcgatggaaccatgcagaatgaggttgccgcttttaatacagctgcattaacgggcgaaagcgtgcctcgtaatattcggaaaggggaggaagtgcttgccggaatgattgtaaccgacaaggtaatccgacttgaagtgacgagaccttttgacaagagcgcactcgcccgaatattggaacttgttcagaatgccgccgaacgcaaagccccggcagaattgtttattcgtaagtttgcccgtgtttacacaccgattgttatcatactggccgtattaattgtattgtctccattggtctattcacttatcaatcctgcatttgtattcacatttaatgattggttatacagagctttggtctttttggtgatttcatgtccatgcgcattggtggttagtattccattaggctattttggtggtatcggagcggcatcccgattgggtattttattcaagggcggtaattatctggacgctatcactaagatcaatacggtggtattcgataaaacaggaaccctgacaaaaggaacctttgacgtgcaggcctgtaaaagtgcaggcgatatttcggaagaagaattagtgaaactggttgcttcggtagaaagtgatagcacacatccgattgccaaggctgttgtaaactacgcaaaagaacaaaacatagaacgtgtagctgttatcggtacgaaagaatatgccggcttcggattggaagcaacggtaggcggaattccggttctggttggtaattgccggttactgtccaagtttgatatatcctttccgcaagaattgttgaagataacagataccattgtagtctgtgctgttggaaaccgttatgccggttatctgttgttggctgatgccttgaaagaagacgcaaaggtagctattgatcgcttaaaagctttaaatattgaaaacatacagatattatccggtgataaacagagtattgttactaactttgcggagaagctcggcatatcgaaagcctatggcgacttgcttccggaagggaaaatgaaacacgtggaagaattgcgtcaggatgaggcaaaccggattgcatttgtcggcgatggaatgaatgacgcaccggtgctcgctttaagtcacgtcggtattgctatgggaggattgggcagtgatgcagccattgaaacagccgatgtcgtgatacagacagatcagccgtcgaaagtagccgaagctatcaaagttggaaagctgacacgaagaatcatttggcagaatgtatcactggcatttggagtgaaattgcttgtgttgattttgggagccggtggaatcgctactctttgggaagctgtcttcgcagacgtaggcgttgcgttgcttgctattatgaacgccgtcagaatacagaaaatgataaaataggagaaagatggaagaagatatttatttggataagctggtcagaagagacattaagccaactgcaataaggcttttggtgataaaagagatgatgcaggcagagcgtgcagtgtcattgcttgacctcgaaacattgctcgacacagtcgataaatcgaccatatcccgtactattgctctcttcttgtctcatcacctcatacatagcatagacgatggaagcggctcgttgaagtatgccgtttgcgacaactcctgcaattgtgtggtacaggatttacattcgcatttttattgtgagaaatgtcatcggacattctgtctggaaggcacccatatcccggtgattgatttgcctgaaggatttactttgcatagcattaattatgtccttaaagggatttgtcaggaatgttcttccgtgggaatgacttggcaatgaaataaaaaagaccgaaacccggaacgataaaaagatcgtcaggtttcggctttctgctttcgctaatattgtttgattagtcaatattgggattcaatgcatgccagtccttaatggctgggatgattcccatttcaatcacttcgtcacgaagtttacataagtgttcgtagctcttttctaattcttcctgttcggcaggagttccggctatttctttataagtaacgccgtctttagtaattgaagtttccatcgccatcatgatatggtcgaatttgccattggaaacatacgttccggcaggccagcggaatggctgtccgcccatagcagcagcaatcatttcgatagacagataagccgggctttggaaagaagaacggccgcgcaggtcgatgatatgttttccaccctggatgacacgtactttcagtgcttcccattccgtcaacggaaggcgggtagtaccgatgaaatcggtcaggggttctccttttattttggtggtagatgcaaatacagccatttgttctccatgaccgccatacgtacgacaattctgaatgtcggaagcggggatatggaagtatttcaccagttcgttttgcaggcgggtgctatccagtgcagccaatgtagaaacttgtgaaggtttcaaacctgcatacaataaagtaatcagaccggtgatgtctgcaggattaaagatgacaacgatatgttttacgttcgggcaatattgacgaacgtcttttccgaattgagcggcaatctctgcatttcctttcaacagatcttcgcgggtcatacctgccttacgggctgctccaccggaagaaacaatataagaagctccggtcagcgcttctttgatgtcggaagtataggtaaggttgacaccttcaaaaccgcaatgatacagttcttcagctactccttccaaagctggtgcgaatggatcatagagacaaatattcggagtgagtttcatcatcatggctgtttgtgccatgttggagccgatcattccggcagctcccacaatcgtaagtttctcgttggttagaaattccataattttatatgtttaaaaaggtgaataatttactctttctttttgtcgctacaaagttaacatattagaacgcagattgttcattgcaaatagttttgcccgataacgaaaagttatagctgactgattgagggatctattcaaaatagattatctttgtatcttatataatataatagataagaatatgagcatcgaattaggaaagttcaaccagcttgaagtcgtgaaggaagtcgatttcggcgtatatctcgatggtggggaagaaggtgagattttgttgcctacccgctatgtgcccgaggattgtaagataggagattttttgaatgtgtttctttacctggatatggatgagaggctgattgctacgacactgaccccgttagtgcaggtcggacagtttgcttgtctggaagtctcctgggtaaatcaatacggagctttcctgaactggggattgatgaaagacctgtttgtgccgttccgtgagcagaagatgaaaatgcaggttggacggaaatacgtggttcatgcacatgtggatgaagagagttaccgtattgtggcttcagcaaaagtggaacgttatctgtcgaaagaaaagccggaatatgctccgggagcagaggtgaatattcttatctggcagaagacggacttaggctttaaggcaattatagatgatatgtatagcggtttattgtatgaaaatgaaatattctgtccgttggagacagggatggaaatgaaagcttttgtgaaacaggtgcgtgaagatggtaaggtcgatttgattcttcagaaacccggttttgaaaagattgacgatttttcgaaaacgctgctagactatatcaaagagcacgggggacgaatcaacttgaatgataaaagtcctgcggaagatatctacgacacgtttggtgtcagcaagaaaacctttaagaaaggagtgggcgacttgtataagaaacgtctgattaccttgcacgaggatggcattgttttggcggattcctaaacagaatagggatttccctacatacgaatagagagaatcattggggtggggagtttcctcaccctatttttgtggtatcagattaaagatataaataataaaaacgagataagttatgcgtaagattataataagtttctgcatcctgttcgctgccctttccttacaagcgcagtctgttaacggaatccgtatcgacggcgggaatactccgatacttgtttacttgggaggaaaccaaatcagtttgcctactactacctgctttatagccaatttgaatcccggacattatactgttgaagtatatgccacccgctttacccgtccgggagagcgagtatggaaaggagaaaaattgtataaagactatgtttatttcgatggtaggggagtgaaagagatatgggtagacggacgtgataacgtgcacccggaaagacccgaccgccccggacaggggggacatcgtccgggacaaggagaacaccgcccaggatatggttacaacagggtcatgaacgatcagctctttcaaacgttttataatgagatgaagaaggagccttttaaagatgatcgtataaagttgcttaatgctgcattggccggttctgattttacatctgcccaatgtctccaactgaccaaactttatacatttgacgatgaccggatggaaattatgaagataatgtatccccgcattgtagataaagaagctttctttacagtgattaataccctgacatttacttccagcaaggacaagatgaatgattttgtgatagggtatggtcggcgttgatactattaactgtacggttatagagatatgttacgcatgtttattgaggaatattatcggaataataaatgataggagattgaattatgaaacgaatactttttttactctttgcggtcggtctgactgccaatatgaccgtaatggctggaatgagcaccagcaaggtacgtaaggagacacgttttcttaccgataagatggcgtatgaattgagtttgagtacacagcaatataatgatgcgtatgagattaattacgactttatttattctgtccgtaatataatggattacgtagcacgtggttacgaatgggcattggatgattattatgaagctttggatatccgtaacgatgatcttcgctgggtattgagtgatgcgcagtatcgccggtttctcggtgccgagtatttctatcggccgatttatgtaaccggagggaaatggagtttcagggtgtacatcaattacccgaaccgtagcttgttctattttggtgtgccttatcattaccgtacttattgtggagcgcattatcgtccacactttcaccatacaagctactatcggggaagatatactaatttcaaccattactctgcaccgcaccgggtgagagatcagagagtatatcactcttatcgtcgttcggacttcggttctgtccggttccgtccgaatacttctactcgtccgcataatgcaccgacacgtccgggtaattcttcccgtccgggttcatcaacaacacgtcccggaacgtctcgtccaagtacatctactcgtcctgatacgtctcgtcccggaacgacaacgcgacctggtacgtcgactcgtccccgtccggaatcaggagatagaccttcaacttctgtcagaccgtctacaccgtccggaagtgggagaccgaataaagaggttgttcctgatagaaacgggaatacaaacagagtagaaggagatcgtaattccggtcgccgtccggaaacaagttccggttcttcaagctctaatcgcaggccgacaagcggaagttcgacaagtagcggttccaaccgtgaaagtggaaagacaagtagcagctcaagggaaagttcaagtaggcgaaacgatagtagtggttcctataatagaaataacagttctgatagaaacaatagttcttccagtcgtggtagctccggtcgtggcagttctagttccaatcgtggcagttctagctccagtcgtagtaattccagtcgcagtagtgaaaatactaccagccgtagcagtagtactacctctagccgtagtagcggtagttcgagttctactcgaagcagcggtagctctacccggagcaatgtttccagcggacaaacagaaagacgctcttcttccggaagcacgagaagtaatagtactcaaagctcttcccgttcttctgaaagaaacagcagttcaagaagataacctattcctttattatttatatcaatctcattgctcctcagtggtaggagaactagactccggtttttcaccggctagactattccgggcgtcgcccgtaacttggatgtcggggcggatactatccgcctcgatttcacttattactccttgctgtgcaagacgttttgcaatcagcttgtagtaaccttccatattctcctttaattgtccgccttctgcaaaagaactgcggaaatgcttgggtttcgggataatggaagccaggaaaatactttcttccgtggtcagttgcgaagggcgtttcttgaaataataagcagacgcttcctgaataccataaacgagcggtccccattctacaatattcagatatacttcgtacatacgttctttggaagttagtctttcattctctatcagccacacaatcaatgcttcttccagtttacgcgcaaagttcttgttacggttcaggaatacattctttaccagttgcatggtgatcgtacttcctccgcgtgcaaagcgtttcacttgcaggtcgtaaatcagtgcttcccgcaaggcatcgggcagaaaaccgcgatgataaaagaatgctccatcttcgctttgcatgacagacattcttagaatgggggaaatgctgtctaggggtgtaaagtgtctgcatgaaggaccgatagggaaggttcgtaccggcactccattctcataagctgtgtaaatgaactcgtcggacattttggagagtgaagtagctccatagcttatgatatggaaatctttttctttcaattcagattccagtttgagactatccagttgcgcaaaatcaatgtctaacagaaaatgataagccagctcgccacttgtcttgatgccttccagattactgaataatcctttcggcagagaactgaacagatcgtctgccggaaaccaggatttgttgactgctgcagtgaaatgccagtttcccttctccttctcgacccgtaaataaggatgaaactggagtttgttgaagtcaacaatggtggtactgtccaattcaaatgagtgtccgtttatgttcatctcgtaacagagttgtccgcgatcgagatgaatgatttcaggagagagggctttatgaaatacgtccagcccgttcactcttgcttttcctttgagatagacttgtttggaagaccctatttctttcgtcaggctatacgataaagtgtcaaaggttatcttagcaccatatctacgtgttatataaggtatggaaacttttagagaatcagatgaataaagcgttgcttttaatgagttgtaatgttggtgcagttcaccattggctatccaatgctgtgctaaactgtcttcttgtatggtgatgacggattgaaaatgattttctttaatgataaaagaaggaagagtgagagatacaaaattattgttttttctttccgtgatacagatattgtttagttgtccgttttcgggcataaaaccataacataaatttaatattttgttgattcgttctgcgtaatttgttttgggggccgtttgtggcgacgttcgagtgagatattctggtttctttctaaaaagaaaatcgtagttggcgatggaatcccgctttgtgaatgcaagtgtaattccgtctgcggctacataacgtatttttatttttctgcttagtaatttccagaagttcagtttgacacgagtggatgtgagtgtcagtaatgtgtctcgttgttcgggtacaacagagagaccttcgaggatgatttcattcaatccattcattttcagattatcgtaatgaatacgtagcccgtgagtttgctcaatatgggaggtacgtttgtcgactatgcttcttaagagagcgttgcgacttaaataaagactgatgagacagatgagtagacccccactggctgacagcagaagaatatgtttcttactgttctttttcatcgtttgattttgataatttatcggatgcaaaggtaggcaatattctgtttcgtagtatataaactgtttttttaattggttgttcgattctaagcgtacaactgttcgttttcgtacaccactctgttttgcaatcattctgattattagcttgttatctttttggcacgctcgttgcatatctatagtcgcaagcggacaacgaagaaaaatgaaaaaagttcagaatgttgcaaccgtttgagacacttgatccgtctaataaacagaagaacaaaaaacagaatgttgaacaaataaaaaatatacaattatgaaaactacagtattattcagaatgatcgttttagttgctatggtatttgcaggtatctctaatgcaacagtgaaggcacaaaacaataacttcattactaatgaagaaacagtaggtgatcttgtagtatcgaaggtgatttacagattagatggctctctttatcgccacatgaaatatgattttacctatgacgatcaaaagagaatggctaccaaagaggctttcaaatgggacgcttccactgacaaatggctgccgtacttcaagattgagtatacttattcttctaatgaaatcactctggtatacgcacgttggaatgattctcacagagcttacgatgcggctgttgaaaagagcgtgtacgaattgaacgacgctaatatgccggtagcttatatgaactataaatggaatgataaatggattgaagaatctagtgtgaactgggctatgaacgtggctactccggcaacgaatgaagcaactctgctgactgccagcagataaaaaaaattaggagttgtgaaacttcttctctctctcttaatttaactgcattaaaaacggtggattgccctatgaggaaatccaccgttctgtttatcagataaacagcttatattgatttgtattactttccggtgcggtgcctatttaacgagcggcaaatattctccataaccttcctctttcattttctctttcgggataaaacgaagggaggcgctattgatgcaatagcgtaatccgcctttctctttcggaccatctgtgaatacatgtcccagatgcgcatccccggttttactgcgcacttccgtacgtatcatgccatgcgaagtatctttcttctctgcgatgatatctttttgaatcggctgggaaaagctaggccacccgcaacccgaatcgaacttgtcggtagaaacaaacaaaggctctccggtggtaatatcaacataaatgcctgggcggtgctcattccagtattcattgtggaaggccggttcggtggcattcttctgggttactgcatattgttccgccgacagttccttgcggagggttgagtcatccggtttttgatacacttttgttttcggtgcattggctttgcgtgccatttcaaataaagcgggattgatatggcaatatcctcccggatttttatccagatagtcctgatggtaagtctctgccggatagaaattagtcaatggctttacttctatagcgataggagtcttatattgtgcagacaatagtttaatagcctggttaatgacaggaagatcttctttatttatataataaattccggttctatactgtgttccccggtcattaccctgacggttgaggctggtaggatcaattgtcttgaaatacagatcgagcagcaaatttaaatctaccgttttaggatcataaaccacctttactgtttccgcagcattggtttttcctgaacagacctgttcataacttgggttggcaacattactgttggcatatcctacttgagtactttctactcctcgaatttgtttcaggaaatgttctgttccccagaagcatcctcctgcaaaatagatttctgcttgatttttcattggtttagcaactcctaaaaatgtattactaatcactacgatcactatgatgataaaatacttcatatccgttagttctttctataataacgaatgaaccaacggatatgtttgaaggaactactatactaaactcaaatatatttctttttattcaatgacttgtcctttgtagaaatccagaattttagtccggaatagatagtcgtatttagcttgcaacttatccgaaagagctttcgtcagattaagtttggcttcattatattctacaaaggtagctttgccgttattgaatttctcactcatcaggcggaaagactcctcgttggctttcactgccacttcactggagttgtacttgctttcagcagctagagcattataccaagcctgctgaatctctttgtagagtactttctttgcgttatccaatctcaaagataagtctatttgttgtaaacgagcggtgcgtactcggtttcgtgtagaaaaacgattaaagatcggaacgctcaaattgaatcctacatacttattcaagttgttctttatctgactgccgaagctgttttctgatcttccgctcaccgtataataattgctacccaaaccggcgctgaaagataattgtggatagaatgcactttgagcaatacgaatgctattaagactaccttgtaaacggtattctgcagccttaatacttggtttgtaagcaagagcctgtgtatatatatcatccggtggggtgagagattcgaactctagttcttccttaggactttcgagcacgaatccttcaggcgtaggtaattccaaaagttgggtgaggtctaataatgataacttgtacgtattgtctgattgtacagcagtcatttcgtcctgtgcgacacgggcttgtgcttcggccacttcagaaggagatgctttacctactccgtggagcccttggatgcgctttagctggtctttgcttaaatctacctgattatgagcaaccttacttaattcttggttgaataaaacctgcaaataagcggaagtgacattgattgcaatgtcttctttggctttattcaaatcttctatagcggcttttaaatccaacttggcaagtgaatattggttggataactgtaaaccggtaaatataggtacattggttcccaagctgaagctggtattggcactgttaatgtcactatacgagttatctatcggagaagcggtacgtccccaactccagttttggctggcgctaccgctcaaattcggaagacgtgtccatttgctagtgtttacactcactttattagcttcaacactgttggccgattgacgaatttctatattatgctcgatagcatagtcgatacattgccgcaatgtccatgcttgcggagagttgttctgcgcttggatagaagtgattccgatcccggcaagcagaagggctgatatggttttacgaattattttcattgaattcaattatttgtcttttttctctgcaccccgtactttgtcctgtgcagttattcctttcttgatttctatcttgattccatcactcattccggcagtcacctgcgtacgctggaacttttgttcaggcactgaatctgtcatgatgtacacaaatgtagagtcgccattaaactcaatagtgctttcgggcactgccaatacttgatttgccctttgcaacacgatttccgcattagccgaatatccggaacgaatctgaacggaatccggaatggtaattgcagccttgatttcaaattggttggcaccattggtttctacccctttcggagagatatattccagaatggcgttgaaagtcagattctgcaaagctccgattgtcagtttgatcggcatctgttcatggatacgtcccacttccgtttcatcaatattaccacggaaaatcatgtcgttcatattggctaccgtagcaatcgtggttccatcattgaacgtgttactcataatcacagagttaccggcttttacaggtacatccaaaatcaatccgtcaatggtagaacgaatcatcgtactactgaacgatgcactgtttttggtaatcccttcttttacgatttccagattatctttagccgtctgtctctcttcacgagcttgcttcaaggctacttcacttttctcatattcttcccggctaatcagctgatcttcgtacaacttctttacacgggcaaaatccgtttctgcctgtgttgcattaatctctgccaggcgcacacgactttccgcagaattcagttgaccgagttcagggattacttttactttggcgataacttcccctttcttcacagcttgtccggcttctttgtacacttcgtcgataatacccgaaatctgcggtttgattaaaatttcgtctctcggttccacctttccggtagctactgtagtcttttggagatcagtgacttccggttttactatttcgtaagtgattaccttgggtttagacttctgataaaggaatacgaatgttccgacaagaatgatagcaatgactaccaataatgtgattttcagatactttttcatgactttatttatatttttattgtttacgattaataattgaaatccctcacacctctttattcgtcgcggatagcttcaatcggtttgatagccatagcccgataagcaggtgccagacctgccaacattcccagtgcgatcagaagagcacaagtgccgattgccagtccgaaggtaacctgaaaacggacgtctcctccgtcggcgtttgctcccatctctaccaattgcaacaccatgacggcaaaagagattccacacattcctgcaatggtagtaagcaccatactttccgatagaatctgttgcagaatatctttggggcgtgcgccgattgcccggcggataccaatttcggtggtacgttctttcacggttaccatcataatattagatacgccgatggcacctgccaacagagtccccaatcctaccatccaaaccagtatgttgatgccggtaaacagattgtctaccatcgagaacattgcttccgcattcaggtacataagtgcctgtttgtcgttaggcgcgatataatgcgcagctttaataatctgctccatttccggttgtacgtcggacactttgattccatgcttcacggtgaagcagatgacgtcgatccgtccccctaagttatacgtttgctgcattgtggtgaaaggcagggtgacagcttccgaagcccgtccctgtatgttcatatccccttcggaggaagacatgccgatcacctgataataaattccgtccacacgtatgtattttccacaagggtcttctcccggtttgaacaggctttcatagatacgctttccgataacacacactttacgcgcttcctgtatatccacttcgttgataaacctgccgtaggccatttcttgtgattcgatgtggagatagtccggatataatcctttcacgctgcaatcgtatttcttatcttcgtatacagctttggaaccccaacgggcaatggaaggagtaatgacctccacatctttgacttgcgaacggaggcgctcgatgtcgatagcttccagattccaccacctgcctttgcggaaacctttgtaagcttcgcccgttttctgtgcggcaaggaagccggagttggttgcgaatccttcaaagttctttttcatcatgccttccagtccttgtccgccgccgatcagggcgacgagcataaagatgccccagaaaacaccgaatgcagtcagcaggcttctcgttttatttcttgtaatggtaatgaggatttcctcacaggtatccatgtctattctcatagtcttaatctgctctaagtgcttcgattggtcggatgctgactgcttttcgggcaggaaataatccggctaacgtaccagctattattaatgtgagtgtagcctgtatggcgattcttatatctactgtcggattcaggaaaacagtttccgtccacattccggtatccattgtctgattgccaaaggcgttattcatccattcggtcactccgatgcccgccaccatacctatatatccgaatatcgtggtaatggtgacactctctacgataatcagccagagaatagaaagcggcttggcacccagagctttgcgaataccgaattcacgggtacgttcttttacagtaatcagcataatgttggacactcctacaatcccgcttaacagcgtgaagataccgatcacccagatggcgatgcgtagcatattcgagccttgctgctgttgcaagtagttggtaaaccggttccaaatccagatagcactatggtctgtcgggtcaaagcgatgattagcccccagtaccttgcggtaatgagcttcaaatgcttcattcgcttctatcgtttccaggtttttggtagtcatgacaaggttattcaacttgtctcctttgttgtaaatcgtttgcagggtggtgaaggggatataagcgtcgctgtctccgttgtctcctttatcattatacagccctactacctgataaaccacattgccggcattgacaaactgcccgataggctcggtatgcgttttatcgaaaagaatctctgctgtctttttatggagcacaattactttccggcgctctttaatatcaatttcattgatgaaacgtcctttgaagagtttcaccacttctacttccgtatggttgggatatacgccggaaagattcaaactgacgtattcttgtccgaaacttaagttaatacctccttgccacacggttgccccggctttaatgacatggtccggaaaataatggtcggtagcatctacgtctttattatccagttgcactcgtcttccttctttcagtccatcgtatgatttgctggtccatcccggaaaaatcttgatggagttcatggcacgttcggaagccgattgctcgaatgcatggatcaatccattgcctgcgcctaacaggacgatcagcataaagataccccatgccacagcaaatcctgtgagaaaagtccttagcttgttacgcttgatggtactgtatatttcttgccaaatatcaatcatttttttaagtattaggtgataagtaagtattaggtattaagtattaagctgcgctgcgaccgcatggaattaatacttattacttaatacttatttcatggaaccgtctttgccgaacggagaggcatcgtggtcgatattatcttcaatgcgttcgataaccccgtccttgatgtgtataatcttgtctgtttggttggcaactccgctttcgtgggtgacaactacaatcgtcattcccagcttatgaagatctttcagaatttgcatcacttccacggaagttttactgtccaaagctcccgtaggctcatctgccagaatgatttgcggttgggtgattaaagcccgtgcgattgccacacgttgtttctgaccgccactcatttcgttgggcatgtgatgtgcccagtcttttaaacccagacggtcgagatattccaaggcaagtgcatttcgcttcttgcggcttatcccttgataaaataaaggaagtgctacattctctacggcatctttaaaggaaatcaggttgaatgactggaagataaatccgatcatgcggtttcggtattcggcagctttggtttcgcttaagttcttgatgagtacgttattcagataatactctccggtgtcgtagttgtcgagaattcccaatatattgagtaaagttgatttcccagacccggatgctcccatgatggaaacaaattctccctgttcgatattgagattgatacctttaagtacatggagaggcgctccgttgttgtaggtcttgttgacgtttgttagttgtatcacaattttctttatttagattctgttttctaataattttctactattagacggctgcaagatacgaaaagttgcaaagaggttgaactttttttgaaaaacattttgtagactcaatcttctttacgtaatttgtgtgcagtaaacttaatgattaactaacccttttaaataaaagtatcatgaattcaaacatggaaaagccctacgtagtaggtattgacataggcggaacgaataccgtctttggaattgtagacgcacgcggaactattattgccagcagttcaatcaaaacatctggttatcctacagtagaagaatacgctgatgaagtgtgtaaaagcctgcttccattgattattgctaatggtggcgttgataaaatcagaggtatcggtatcggtgctccgaatggtaactattacacgggaacgattgaatttgctccaaacttgccttggaaaggaattcttccgttggctgccatgtttgaagaaagactgggtatccccactgctttgacaaacgatgcaaatgctgctgctatcggtgaaatgacttatggcgctgcccgtggtatgaaagactttatcatgattacactgggtaccggtgtgggtagtggtattgttatcaacggccagatggtatatggacatgacggttttgcaggcgaattaggacacgtgatcgctcgtcgcgatggtcgtctttgcggttgtggacgtaagggatgtctggaaacttactgttcggctaccggtgtagctcgcacagctcgcgaattccttgccgctcgtacggatgccagcttgcttcgtaacattcctgcagaaaacattacttcaaaagatgtatatgacgcagctgtacaaggagataaattggcacaggagatcttcgaatttacaggtaatatcttgggtgaagctttggcggatgctattgcattctccagccctgaagccattgtattgttcggtggcttggctaagtccggtgactatatcatgaaaccgattcagaaggccattgatgataatatcctgaatatctataaaggtaagacgaaattgctcgtttccgaattgaaggattctgatgctgctgtactgggtgccagtgcattggcttgggaactgaaagatttgaaagaataatatatcattattataataaaggtgatgaagcctcgggagtctatgactttcggggctttgttttattattcctttccgccatctacaaggcatctacagcctattcagaaaagggtttattctcactagtatgagaaataatactcatactaatgggaatatattctcataggtatgagtattttttctcacaggtgtgagtatagttgagaaaatgtacttcccagataatagctttgcgagaatggtagcaataaaaaagggaacttcattcattatgaagttcccttttttatttcgaatcgaaaagttcggcttagccgttagctcttttttctttgattctagctttcttaccagtaagagcgcgcaggtagtacaatttagcgcgacgaactttacctaccttgttcacttcgatgctgtcgatagccggtgattcgattgggaaaattctttctacgcctatagttcctgacattttacgtacagtaaaacgtttcttgtctccgtgaccggcgattttgataacaacaccacggtacaactgtacacgttctttgttaccctcgataatacgatatgccactgttacagtgtctcctgctttgaagctcgggtgctgttttccggtagcaaatgcttcttctgcaattttaattaaatccattgttgttattattaaattgtttcatcgttacaacgcaacataccaagtatctcttctcttgacagcgattgcgcgaaagcggtgcaaagtaacgaattatttgccagatagccaaatgtttttgtatatttgtagcatatctaaaaatagcgaacatgaaacagacttatgtaaagtatctgatggtggcagcgtttgcaggaggtttcctgtttacttcctgccggaccgcacgcgagactacggcacagtacgaagtaaccaaagtagagggtagcatgataacgattgattctgtttgggacaccacccccaacgtgaaagctaccgaaatcttaaagccttataaggaaaaggtggatgcgatgatgtatgaagtcatcggtaccagtgcgatgaagatggataaaggagctcctgaaagcttgctatccgaccttgtcgcgggtgttctacagcaagcggcaacccaggtattggggaaaccggccgatatgggattggtaaatatgggcggcttgcgtaatatcttgcccgaaggagatatcacggtaggagatgtttttgaaattcttcctttcgagaattccctttgtgtattgactatgaaagggacagacttgagacggctttgtgaagcaatagcgtctctgcatggcgaaggagtgagcggtatccgcctcgaaatcacaaaagacggaaagctgctgaacgcatttattgccggaaaaccgttaaaagatgaccagctttacacagtggctactatcgactatctggcagacggaaacggacgaatggatgctttcctgcaggcagaaaagagagtatgccccgaagatgctaccttacgcggactgtttcttgattatgtacgcaaacaaacagccgaaggcaaagtgattacctccaaactggacggacgtattacgataaaataaaaaaggagaatctaaaaatattgaatatgaaaagatttcagatattattcctgctatgtcttgcattgagtttcactttttcaatctttgcgcaggataccaaagaagtgatcattttacaaacaagcgatgtgcatagccgtatcgaacctatcaatcagaagggcgacaaatattataacaaaggtggttttgtccgccgggctgcttttctcgaacagttccgcaaagatcataagaatgtattgcttttcgattgcggagatatttcccaggggacaccttattataatatgttccgtggagaagtagaaattaaactgatgaatgaaatgggctatgatgcaatgacaatcggtaaccatgagtttgatttcgatgtggataatatggcccgtatttttaaaatggctgatttcccggtcgtttgtgccaactataatctggatgctacggtgttaaaagatatagtcaagccctacgtcgttctggagaaatatggtttgagaattggcgtgttcggtctcggaacccagccggaaggaatgattcaggccaataaatgcgaaggagtcgtttatgaagatcctatccgtgtatccaacgagatagctactttgttgaaagaagaagaaggttgtgatctggttgtatgcctgtctcatctgggcatccagatggatgaacatctggttgccggaacacacaatatcgacgtgattctgggtggacactcccatacatttatggaaggccccaaaacatacttgaatatggacggaaaagaggtgcctgtcatgcacacaggaaaaaatggtgttcgtgtaggccgtcttgatttgacattgaaacataaatgaagataattcccttaatagtaacgcttttattccttatcgcggtcggcacagtttcgagtccggcgcaaaatgctaccaccgttgaacctctactggtatataaagcccttcaggacaaggactgccggcactgggttgattcggtgatggataaactttcctttaaagaaaaggtaggtcagttattcatctataccattgctccggtagacaccaaacgaaatctggaactgctgcgcgaagtcattgacacttataaggtaggcggccttctcttttccggcgggaagatgcaaaaccaggtcgaactgacgaaccgggcgcagcgacaagccaaagttcctttgatgattacctttgatggagaatggggattgtctatgcgcttgcgcggtacgcctgtcttcccgcgaaatatggtgctgggatgtatccgcgacaaccggctgctttatgagtacggacgtgaagttgcccgccaatgccggcagattggagtgcaagtaaactttgctcccgtggcggacgtgaatataaaccctaaaaatcctgtcatcaatacccgttcttttggcgaagatccgatccaagtggccgataaggtaatcgcttatgcttccggtttggaaggtggaggggtgttatctgtgtgcaaacactttcccggacacggggacaccgatgtcgattcgcataaagcgcttccggtacttcctttcactcgcgagcgtctggatagtgtggagctttatccttttaaagaggccatccgtgccggactgggcggtatgatggtggggcatctgcaagttccggtgattgaacctattggcggacttccgtcttccttgtcccgcaatgtcgtgtatgatttgctgaccgatgaactggcgttcaaagggctgatatttaccgacgcgcttgccatgaaaggtgtggcaggaaatggaaatgtcagtttgcaggctttgaaagcaggtaatgacatggtactgtctccccgtaacctgaaggaagagataccggccgtactggcagctgttgaaaaaggggaactaagccgtgaagagattgaaaacaaatgccgcaaagtcttgacttataaatatgtgttgggacttaagaagaaatcgtatgtacaattatccggtttggaacaacgcattaacagtccgcagacacgtgacctggttcgtcggttgaatttagcggcaataaccgttttgagcaataagaatcatatccttcctctacatacagacaaggaacaaaagattgcactgctcgaagtgggaaatcccggaaaaactgatgtattggccaaacaactttcccgttatacctctttagctcgcttttgccttcgcgctaatcagacagaagaggaaaatcaacggttgcgtgattctctgtctacctataaacgaatcattgtagccattagcgaacagcggctggcttcttatcagcctttctttgcgaagtttgctcctcaaagtccggctatttatctgttcttcactcctgggaagatgatgttacagattcagcgggccgtggctcatgcttcggcagtcgtgttgggacatagttataatgtagacgtgcaacgtcaggtcgcagatgtgttatttgccaaggcatccgcagacggacagttgtcggcaagcttgggagaactgtttccaacgggagcaggagtgaccattacccccaagacgccattgcattttgtgccggaagaatatgggctttcttccactcatctgaaacgcatcgattctatcgcattagacggtattcgtcagggagcttatcccggttgccaggtggtagtgttgaaaaacgggcatatcatgttcgacaaatctttcggcacttatgcgggtaaaggaagtccgcgtgtcgaatctaccagtatctacgatttggcttccctatcaaagacgacgggcactttgcttgccatcatgaaactctacgataagggacgtttcaatctgacagataagatttcggatcatttaccgtttttgcaacgtactgataagaaagatataacgattcaggaaatcgtgtatcatcagtccggtttaccttcctggattcctttctaccaagaagctattgataaagatagttatgacggaagattgttcagcgcacgcaaagacgcgcatcatccgttacagttgggaacaacttcatgggcgaatccgaagttcaatttcaaaagtgaatacgtctctcccgtcaagactggtgattacactgttcaaatctgcgatagtttgtggctaaaccgttccttccggaaggtgatggaagagaaaataatggaagctccgttaaagcagaaacgctatgtatatagtgatgtcggatttattctgttgggtatgttggtagaacaactggccggtatgcctatggaagcctatctgcaacgtgagttttacgaaccgatggggttggagcatacaggctacttgcctttacgccgttttgccaaatcggaaattgtcccttccaacaaagaccgtttcttgcgtaaagagactttgcagggatttgtgcatgatgaggcttccgctttctttggcggattggccggaaatgccggacttttctctactgcccgtgatgtagcccgcgtttatcagatgttgctgaatggaggagaaatagatggtcaacgctatctaagcaaagaaacctgccagttgtttactacggaaacttcaaagatcagccggcgtggcttgggctttgacaaaccggatgctgatgatccgaagaaaggaaattgtgctcctgccgcacctgccggagtgtacggtcataccggctttaccggtacatgtgcatgggtagatccggtcaatgaactggtttatgtattccttagcaaccggatttatccggatgtaacaaatcgcaaactgaaccaactgcacattcgtgagcgaatacagggggcgatttacgatgcgatgaagaaaaaataaaaaaagaaaggtaaaaggtgcctatattaaaagctaccttttaccttttttattattaacgtaatattctgatagttgtcagccagtcttagaaggatacacccaggcggaagccgaagttgctcaatccatctacactgtaatgcagtacgtcagccttgttggtaccatagctgtagtacaaagcaaagtgcaaacccggtccgtaaacccatgggaatacattgatacctacttcaggagaagcatagaatccccaactgttttctcttgcttccagcatgctgaaattagagcggattttagcatattcagcacctaatttagcactgacgtatggttgaaaggctctaccgcgattccactggtaacgtgcagcagcaccgaaaggcaattggaaaatggtatgttgctgatcggtagtcacttcaccggcgcccatctggaaggtttcgcgacctacatattcgtggttgctgtgatagttgaggaaaagacccaaaccgatgttaggagtcacgaaataaccaccttcgaagttcataccccaaccgcttgctttatcagcaaaattgttacttagcggagcgttgaactgccagtcgatatttgcatatccattgtccgatagctgtgccttagccggcatggcgaaggcgatggcaatagccgccaaggctactaccttgaagtatatattttttcttgttttcataacagttgtagttgtttatttgttagtaagataaggtgactgtgtaaatgactggttgacagcttctactgcaagagtacggttgatagctttggaaccagtttcaaatccggtcagataacttgtccatacaacaggcagttttttactgtctccctgttcggctttcaagttcaccatttctgtcaggaaggagttggtgctataactataagttactgcatacgggtagtaccatccaccaccccagttgccaccccagtagccagggccccaatatccgggataaccccaccaccattcaggttgtgtgtagctggtgaaataataagtacttgcgatgtagcttacctggataccaagatctgcgctttcctggtcagctgctgcttcgtaacctctagcttccatattgtctgtataagctgccagaatttgttctgcgccttcaccttcgagatattccggttctttactatcactgatgaccagaatctgtggtgccagatagaatgtaggaactttgaaatcggctttcttgtcgtagttagtgtataccagataattgtcatccagtttacccatgtccgggtctttttcacatgaagcgagtgcaaagaccgccaataaaataggaattaatttcttcatatcttttataatgtttaggttatataaaaatcacgcccaggtaccttgggcttttgatacaaacaacaagaaaggtggaaaaaggttcgcgtggaaatttcttttgccggaaaattaacatatttctttggcccggcggaaagaaaaacggtgagcgctctgccctattatcagggagtttgctcaccgtttattatttacagatatttatttgaaaaatccgtttattaaaacagaggttttagtagatctggtatttctaccttatcaagttctagttcagttacccgttgtttacccaattgagtcagatggaaatacatctgtctccggtcttcacttccgagtgatcggacgattagtcctttttcttccagtatccgcagcattttggatgtgtgtgaggggcttagttcggtttgtttagacagattggtagccgtcactttgtccgaagcctctttaagggcacacaatatcattgcttcattaagcgttatctggtacattttttcaaatgctgtttcaaagtttcccattgctttgaatacgtcacgcattgcacatattgttttcataccttatttaaatatttcatttgttcattttttaaataaatagattaacgtttgcgttatccgcccgttccatatacgttgctacgccgccaatggtcacctcgtccaggagttcttcttgtttgactcccatcacgtccattgacatctggcaagcaataaattccacaccgttttccagcgcttgctggcgcagggattccagtgaatcaatcccttttttgttcatgatataccgcatcatttttccgcctattccgcccatactcatcttagaaagtttcagctttttggagctggaaggcagcatcatgccaaacatttttccgaaaatatccttttcggtttctggtttgtgcaacttcttgatgacgttcagtccccagaacgtaaagaagatggtgactttttgtcccgtagctgctgcgccgtttgctagtacaaaagtggccaaagctttatccaaatcatcactaaacatgataaaggtttttcctttgccctcacatgaagtaacaatattgcacgattttggttctcctttttctatgacaacaacagattttcctccggagctgtctttcgaaatcagttgattgcccgttgaactgcaccatgcggcagcgtcacgcggaaatcccggatcggttgaggtgatttccacccgttcacctgatgccagtgtatccattgttttcttcattttcaaaatcgggccgggacattgtaacccgcaggcgtctacccgaactgttttagcggggtttgcaagggcatcggcggtgacggcagccgtggcagtaaccgtggtatccgaaaccttagcaaccgcaggttgcccaacttggggactacctccctgttgtttgggtgattcgtctatttcatttccattttcttcgcgtatgataatcggagcagtggcagcccgataagtcttcagtcctcccgagagattacgcaccttgtcaaatccatgttgagtcaatatccggtaggcaagatagccccgtagtccgacagcgcagaaggtataaatcattttatctttcggcagttcggccagccggtcacgaagctcatccagcggaatattcacggcacccggtaggctgcctaaagaatattcgtccggggtgcggacatccaggaggaacttattttccatttcaatgtcccgcaactctctccaatataccggattggttttgccggtaatgatgtcttccgctacatatcctgccagtgctaccggatctttggccgaagagaacggaggagcatacgcttgttccactttcatcaggtcgtagatcgttccctcgtgtttgatgacaagcgcgagttcgtcaatccgtttgtccactccgtcgtaaccgacgatttgcccgccgtacaatcttcccgtctttttgtcgaaagtgattttgatactcatcggcatggcatccggatagtagccggcatgagaggcgggatggatggtagatgacatataatctatctcttcctggcgcaggcgcttgccgggtaaaccggttgaagcaacggtcatgtcgaaaacttttgcgattgaagtgccgatagaaccttcgtaaggtatttttgccccgagaacgttgtctgcaacgatgcgtccctgacggttggcaggtccggcaagatagttgagccagggttttccagtgatcggatggcggaactcgattgcgtcaccgatggcataaatcgattcatcagacgtttgcaggtaatcattcacggcaatacctcctgcggggccgatagtcagttcggcagctcgtgccagactggtttccgggcgtactccgatcgacaggataacgatatcggcagaaatggactgaccatttttgaacgttactttcaacccttttccctcccggctaaaagaggcgacagcttgttccagataaagattgactcctttatccatcaagtgctggtggacgagcgatgccatcgagaagtcgataggagccatcacttgattgcccatttccacaatcgacactttcgctccctgtgtatgtaagttttccgccatttccagaccgataaatccggctcctacgataacggcttttcgcggagcgtggctcttgatatattctttgatccgatccgtgtcggtgacattccttaacgtgaagattccgttaaggtcgattctcggaagaggaggacgcaccggggaagctccggtggagatgactaatttatcgtagctctcctcataagtgtcttcactgctttgccggatggtcactgtctttcttttccggtcaataaaaatcgcttcgttttctgtacgtacatctacacggaagcgtgtagagaaggcttcgggcgtttgcacgaacaatttatcccgttcctctatcactcctcctatataataaggaaggccgcaattggcgtatgatatatactttcctttttccaaaaggataatttctgctgtttcatctactcgtctgattcgggcagcagtggtggctcctcctgcaactcccccaataataattattttcatctgtttatagtgtaaatagtttcctgtggaaataacaaacagggtcgaagaaatgttcatggattcagataaaaaaactatatttgcgcaccctgtttttcattcttctatattaatgtagacaatttgtatgaataaaattcttattattgacgatgaagtccagattcgcagccttttagctcgtatgctggaacttgagggctatgaagtgtgtcaggcaggtgattgcaaaactgccatcaaacaactggaaattcaatcgcccgacgtagctttatgtgatgtttttcttcctgatggaaacggagtagatctggtgttgaacatcaagaaaatagctcccaatgtagaggtgattcttcttactgctcacggcaatattcccgacggggtgcaggctattaaaaacggtgcatttgattatataacgaaaggagatgataataacaagattattcctttaatcagccgtgccgtggagaaagcaaagatgaatgtccgtttggaaaaactggaaaagaaagtcgggcagatgtactcgttcgattctattctgggtgagtcaaaggtgttgaaagaggctgtatctctggcgcagaaagtgtctgtgacagatgttcccgtattactgacgggggaaacaggaacaggaaaggaagtctttgcgcaagctatacattatagtagtaaacggagcaaacagaattttgtggcggtcaactgttcgtctttcagtaaagaactgctcgaaagcgagatgttcggacataaggctggctcgtttaccggtgcgctgaaggataagaaaggactttttgaagaagctaataacggaacgatctttctggatgaaatcggagagatggctttcgaattgcaggcaaagttactgcgtatccttgaaacaggagaatatataaagatcggtgataccaagccgacaagagtcaatgtgcgtatcattgctgctaccaaccgcaacctgcaggaggagatcaaagcaggacatttccgtgaagacttgttttatcgtctttcggtttttcaggtgcatcttccttcgcttcgtgaacgtaccggtgatatcagaattcttgcaactgcttttgccaaaagtttctccgaaaaactttcgtatgccatcaatgagatgactcccgcttttctggaagcgctggaacaacagccgtggaaagggaacatccgtgaattgagaaatgtgattgagcgtagcctgattgtttgcgaaggtggacggttggatatctgcgaccttcctttggaaatccagaacactcattatgaatgttcggacgatagtacaggtagttttgaactggctgcaatggagcgcaggcatattgcgcgtgtgttggaatatacgaaagggaataaaacggaagctgcccgcttgttgaaaatcggacttactacgttgtatcggaagatagaggaatataaaatctgaatatacattttaatcaggccacgtactggctttcgagaaattgtttggatagcgaactgattagtttgtttttatctgtgctgtgcacagatagtgtgagccgatgatatgtattacagacatattttcgtccataaccatttcggcatatttgtgtagttccctttcaatgattcgcagggtgtcccggctgcccgtcagcatcatcgagatagatacattggatgaggtcattgagatgacattgatttgatatttgttgataacttccaatatcttacccataaacaaatatccgggcaatacattcaatgaggtaaaacgtacaaaggtagccgaatcctgtgagaggatggctttgacactgttgcctgtgtcatgggaagatatatagaggcgttctgttgacagatcgtgtgtatcggttaggcggataactatattagagcgtgccgcaagggtgatacaatctgcgtagagcaggtgtactccgctgttaatcagttgttcggcttctatgtaagttagtgaatgttgttctcgcagacaattccggtttgcgtagatatggttgataggcgtggataacagtatttcgtccgctttgaatagggtggcaagcactgttgcatagtaatcattgcgttgttcgctcatgaagtctatttcaccatacacattcctgcaaatggaaagtggggcgataaaaatatctacatttcggttctcgtcaatgtattgttggatagattcctgaatatatgggatatctggctttctttccaggttgatctgtataagcttgccggtatctaatgtttgggcacgaagcccctgttgacgtaaacaataagtgaataaatcgctggataatccgtatacctcggcttttatcattttatcaatcagcaaatctgctttgtcttctacaagtatatgtattttctttatgcactccagaatccggttcttaatttcctgatttaagtgcgaatctgtaatgagatgattggcaagggtacagcaatatgcttcgatggcattgactgtggcatgagaagcttcatcttcttcgtgaaaccaactgatggaaatagcctgtaaccactcctgtaattgtgccaatatagggactacagctacataaggatgttctttctgaatacaattgattacttgcttcatttcatcctcatctttaattttctcgaatttacaaactttcattgttatctggttatttattggttactactcttttcaatcttttcaaaatgatatgcttttttcaaaagagaaagatatcttatcatcattcttttactttcgaatccggtatatctttataaatcaatctgttaatgttgcaatcaatgtttttaatacatttctttactataagtaatctgctaataccataccacattgggatatgaaaataagatttcttatctttgttgcgtaattgattgataaaccagtaatattcgtccatttatgaaactctgtatctagctaagctcaacgaatagcatcatttccaacagggctattcagctatccgacaggcaactactctcctgccaaagagttttatatccatttttataaatttacggaactgtgtgctgctatgatgtggtatgccgtatcgtgttatttttaagttgagcaatgaattatacatataagcaaatatggctcatcaactttcctgtgatgatgagcattctgatggaacaattaatcaatattaccgacgctattttcctggggcatgtgggagaagtcgaactgggagcttctgcgcttgccggaatctactatttggctgtttatatgctgggcttcggatttagcatcgggctgcaggtaatgattgcccggagaaatggggaacaacattataaagagacgggacgtacattttttcagggagtatatttcctgtcggggatggcagtcattctttgcctattgctccatttggcttctcccttgatcctgcgccggttgataacttcggatgaaatttatcaggcagtgattcattatctggattggcgtagcttcggtttgttattctcatttccttttttagctttccggtcttttctggtagggataacaacgaccaaagcattgtccgtggcagctatcatggctatctgtatcaatattccttttaactatctgctgatattcaaactgaatctgggtatatccggggcggcgatggcttcttctttggcagagttcggagcttttatcgtactcctattatatatgtgggtgagggtagataaagtgaaatatgggctgaaggtcgtttatgatgagaaagtgttaataaagttgttgaggatatctgtatggagtatgcttcactcttttatcagcgttgctccctggtttctgttcttcgttgctatcgagcatctgggaaggacagagcttgctatttccaatattactcgtagtgtttctaccgtcttttttgtgattgtcaactcttttgcatccactactggttcattagtcagcaatctaattggggcggggcaggggaaggaactttttcccgtttgccataaagttcttaggttgggttatgccgtgggagttccattgatagttatgactctttggggtaaccaatgggttatcggattttatacgaataacgataatctggtgagactagctttctatccttttatagttatgctgttgaattatgcttttgcactgcccggatatgtttatatcaatgctgttaccgatacaggaaagacgaagctcgcctttatcttccagttaatcaccattcttgtatatttgatttatctgtatctgttaagtgaatgttttcatgcttctctgactgtgtatatgacggcagaatatttgtttgttattttattagggatgcaatctatcatttacttaaagaggaaatccaactagaatatgtatttttgtactttcaatacttgatactttctcgaaatgactgaagatataaagaataaacttttgatgtgtgcggagatgtatcatcgcgcagactttatacaaagcgatccggtgcagtttccccatcgttatacgctgaaacaggatatcgaagtcagcggtttgctgacggcgattatgagttttggcaatcgcaaacagatcttgaagaaagtggacgaattgcacgggctaatgggagattcgccttatcagtatgtactgtcccgtcagtgggagagagatttcccatcgggagcaaccagtagtttttatcggatgctgtcacatgctgatttctatggatattttcagcgattatacattgcttatacacagtttgaaagtctggaagaagccttgaagacataccccggaataccgatggaaaagctatgtgcatttcttgaagtctctgccaaaagccctcaaaagaaactgaatatgtttttgcgttggatgattcgtcgggactcggcggtcgatttgggcatttgggagagttttgatcgcagggatttgattgttcccttggatacacacgtctgtcgggtagcccattatttcaagttgacggatgcggaaacattttctttgaaaaatgcccgccagataacggcagcattggctgaggtcttcccagatgacccttgcctgggcgatttcgccttgttcggcttaggggtgaatggggagatttaatgcatggcttgatagaatctcagaaacaatatgttgcttcagtgaaagatactgttttattgcgtgatatctaaaacgcaaacctgtccgtgatgtaaaactgctggatgatacttttatttatttggttaataatgcatcaaacttattttctgtccaaaatctgattaatttctttaagtctaaaaatcggagagtaagttatgacacattatctaattatttaggttatatagaagaggcttttttagcatatagaacagaacggtataatataaaagggaaagatgtagtagccggtaattgtaagtattatcagaatgatttgtcctttaagaattttctctatccgggattttcttatggtgtggggtgtttgctggagaatgcagtatatttggagcttcgtcagttgggatattctgtatatgtgtgtgctattcgtgataaagaagttgactttgttgcgatgaaggacgatagagttatatatcttcagaccacttatatgttggaaacggaacaaacaatagaacgtgaatattcacctttactatcaataaaggataatgatgagaagtatgttgtttctgtagatgagatacagctcccctctaaagagggaatacgacatattcaggtttggaatttgaatgaaattttataaataatcgattatattcggaagagtcgatacaaaattaatgggtaatccattattaaaagttgatagacaaagaactactttaccacttgttaagtagtaacagggtgtttttcggacactctcaacgtactattatatcaatgttccttaaatctctaacccttaatgcaacaaatattcaactttaaagttgaatatttgttgcattatactgtattattcatatctttgcataaagatattttagatatggatatagaaacagtcgataaattcttgagagaatttaaagataaggctagagctttcgggattgtctttcgcatagatagaaagaagaatatgcaagccttgcttgatttggaaatttcggcaattatgcgtgaaaagataataatgtctttgacagttgaagactattataaaggtcctacggaagataaattgaattatatgggagaactttgggagtttggcaagtccgtagataaaaaggaggtctatatcaaaataagtaaaggtactggaacaaattctccaatctgtgtctcctttcatttggcagagagaaaaatagaatatcctttcaaaaataaaaagtagaagttatgaaaagtccgtttacaggtggtgacgctgtattgtgtcatgaaaagcaatcatttgaatttcgaaaagacaattttgagatagtatatcatttttatagatgtaaggatacaaatgaagagtttactacaactgaacttgatcaactgaatatgaatcaagtttataatttgtatcgtcagaaatatgcaataccatttccggatgaaataaaaagggtccgtgaattatatggtatatctgcacttcgaatgtctaaacttttaggttttggcgataaccaatatagaaaatacgaagaaggagagatgcctagtgtgtctaatggaaaaatgatttcagctttgaaagatcctcatttctttttggaaattctgaaacttgctcaaaatcagtttcccaatgatgagatacttaaaattgaaaaaagggtaaaggaactgttattaaataattcctgttttgagaataaaataaatgaatttatatttcacaaccatttgtctttacgttcaagtatgaatgggtatgcttctgtcattcccgagaaggttaagcagattattgtcttttttgcatctgcattacaaggagtttttgaaacaaaactaaataaattattattttattctgattttctttcctataagaaatatggtaaaggtattagcgggttacaataccaagctataagttatgggcctgttcctgtgcgttatagtactatatatgagaacttagacggattaaaaaaggaaatcataaatttgggaaatggttattctggaagtataattacaactgttgagcaatttgaacagtctttattcacagttgaagaattagaggttttacaatgtgtattagctcattttgagaagagtaaggctaatgaaatttcagaaatgagtcatgcagaggaagcatggcgccaaaatgaaaaacagcatagcttgattgactatagttatgcgtttgatttgagacagttgtaatgtatgcttcattttgataaatggttagctgtgttctgttaaaatgcatccgaccgtttttctttattttttcctacggatattaggtttgtaatatatacgaaggaaagaaaggaatctttcaacaggctgttggaaaaagagcgaatataaaaaagttaccccaatttaaaaagtaaaggtagtagaacaaataagcaggacctttttagaaggtttcttctttatcttcttcgaggcgtatgagaggactatagtaaggaattgggagagattttactttacaactggaaaactaaaaacttctaaaaattctaaggttgtctctggagcttttgcaagtctttccaagaaagataggaaatttacaaaataagagaaaataattattttggcaagatagagctctccgaatgtttacgaaaatagttatatttgtacttgtaaacaaggggatataatggatatctgggataaaaagaaacgttccgacgttatggcaaaaatcagaagtaaggatacgaaacctgaatggatcgttcgtcgttacttatattctcgtggctaccgttaccgtaaaaacgtaaaggggttgccgggcacgcctgatattgtgttgcgtaaatatggtattgtgatatttattcatggatgtttttggcatggtcatgaagttgatgggcatattccccattctaatgttgatttttggaggaagaaaatagaacggaacaagcagcgtgatgaacataataaagaagctttaaaaaaaatgggttggaaagtcatgaccgtgtgggaatgccaactgaaatctgcggttcgagagaaaacgcttttggaggtggagtattggattaatcattcttatttggaacgtttttaagcagaaaacgtttaaggtttacaatattgaggaaacatgtttgtctattgtagctgaagaatatgtaaattatgagaaaactaaatgaaagtgatatgtaatgcgaaaagctgatgatattaaactgtttctgtctatatataaatatgaggaacaaaagatgatggtaataatttaaatattttagaataataagagcctgtttgaattttcttcaataataattttatagctacaatttagaccattttctctgccgaatcgaatgttaattcatagtttcgacagagccttctgtcattgtccatccacgagaatgatcttttccacaatccatcttttatgaataggtttgaatccttgttctttgtatgcatgcactaataaccacttgaattccataaccaatttgtttttgatgtttccaataagttcgcctctacatcctccgtctgccagtataacttttattcctgaacaaagttcttttaatactctcattagcagataagcagctttactgtcatggacgttggctactgtaaccatcactgcaattagaaagccattttttttgtccacagtaaaacataaacaaggttcgatttctgagatttttttgtatctttaccatgtgtttttatttttaattacccccgttttggccgtcaaaccgtttttgggggggatgcttaaagatacaaaaaaggcaactaactcgcaatgaattagttgccttaaactttattattttaggaatatccttaatcaatatataaaatacttttttaggaatggctatataagaacagcttgctaacagacagcaacctatttttagagatctgataatttcatcatttgaaagttccaactcccagaatcctaaaacaagagtttccataattgcttttcaaatgagcttaactataaactctttcaatgtttctgctacagcttttgctaatggaactggaacaccattaccaatcattttaaatttttttgagagaagatttggagtagttaaaacataggaatcatctactccctgaatacgaagagcttccctgacagacaaacgtctatgttgatatgggtgtaaatgaacttcattattcccgtagcaagcagtcggactatatttatagcgatgtaaacgtttaaatgaaggtcggttggtttctccttcctttattttagcaaattgatttgcttttccaagcaaattaaagtattcgttagcattcggaataataaattcatcatcttttgatacaagacaagatgctaaacaaagctgaaggggaatattttggggtttttcaatatttttagtaccaaatgcaatggcttctggccatttatattgtttatgaggattggtgtattttcgtttactgtgaaatggaaaccacttgttattgagattagctgttattgaacttaaatcaaaatgttttctgtttaatcctacaacaaaaatcctttcacgggattgcggaactccaaactctaaactatttaatgtttcccaatcaataagatactcctctgacatgatctccaataattctaaaaaatgttttgcgtttttctttactcgcattagtccagttacattttccattataaaaaaggatggattaagatctaatattctgcacaagtaagtatctgtcaacgagcctctttctcctttaaacccctcaagattgccgttaatgctaaaatcttgacagggtggtccgcctattattccgaacaatgttgggatttctttaccaaaggcttgtgaaagaattgtattagatggtatatcctttattgagttggtattcgaaatggaacatttttgtcctttagataataatttatatttttttttccaggatgtaattccttcttcataaaatttagcaaaagcaggttctatttcgtttgtccaaactacattaaatcctgcttgtatgaatcccatgtccatgaatccacctcctgtgaaaaatgacaacactggtattgggttgtttgtatttactattttgttatccatattctccattcttttggactgttttgggacattttattacctgatactatatcattaatccattttcttgtgattatttgtacaggcaataatgtaaatatagctttgtaattttgaaatctttggttgttttgggttttccaaatagcaattaaatcttctgtttctaaatggttcgtgctaccaggtactaataaacctttaaaaattcggtcaaagcctgttgatcctttagaaaataagaagattggggggacttcattttttctattcaaatgaagattattaaaaattcctctaaataatctattccctagtgtttcatgtatttctcttcctggttccttattatctccataataagttactaaatctccatttattaaatctggccaatcaatatcactaaaggtagaataaagaactacaagtgaaggctgttctgaggtacctgcaaatcgtattcctgattggtttcctactggaagaatttttgagattggttcgcttgataaattatttgcatcacctcctttgcaaatacaatcttttatcaggtctgatttattgagtttattaaaatctattatattcatctttttattatttaataactattgaatcatatcatatacgcaagagtatttattcatagaatatgtgttctcatctttatgttttaatccataaaatccgaggtagtcaccaattttgtatttttctatagcaaacgatggtgcaatttctactatactaattggtctttcattaacttctagtgttatatttacattaccattaaagaaatgtttagtatttatcaatctcccaataacatcgtttgtttgtgaatttgtttgcaaccatgaatggtaaaaactacatgctggcctatacaaacaatatctgcaatttgatatagaacaattggctaatatagaaaattggcttttttgaatgttggaatttacttctaaaagaagattttgtgcttgcttgtataaggattggcactcctcataggtaaaatcgatttttatcgattttttattcatgtcaataagacatagatagtcaggatagactttataattgatgaagtataattgagcatataatttcaactggtattcataatcatcttttaccaaagaaattatttctccactttcatcgactatattataagtcaattttcctgttttgaagtcccaaatacttgttgaattcaccgacttagttattaaatcagccattccaccaattgtcccattttcattttgtaaccatttctctgaaagtatttctatatgtttatttttacttatagaagtgtttgggctattttttaattgattttttataaggattttctttaaaccgatattttggatgtgttttttcaaaggaagacagaaggtgattccttcatgacgtaactcattttcttttgatttaatttcgctttcccatgcctcattaaagttttcttctgagatttttccttttattattttttccatcagtttatgaaacacagatccaatataagtattgggtgacaatggtattagcggacgccaatcaaaagcttccgctaataccactttataaggacactgtaccattgcataaaaatggctgggcgcaatacgtgttaattgcttatattttattttacttggtgatagacacataattattttattattttttcgtaacaccaacctatcctacgatgcaggttaaatgtatctagggttttgatatcatcagaattcggataattggggtcgcctccttgtgtagcgacataactttgagcttctgcaaaacactgggtataccacgcgtcttctgctaaatcatcaatattccaaaaaggatgaattattaaaatgactttttgctttcgttttctatttccatattttatggctggtagtccgttgaaattacatttgtattcttctcgttcttctggtgttttcccaaagcttgagaaactttcaataaatgaatcgcgaagtttttcagcaaattgtagccaatctttcaattctacatattgggagaagttaccatctgccccagctttgtaattgggatcattgaataatcgtatcatacttaatcccaagcgccagtcaagcaaactgtgccaattcatgttcctgaatatttttaaacaatcatagcaagcgtcagcacatttctcttgatgggtgaggctgtgtattttacctaaataactatctgcatttgtaggttgaagtgtttcttgtaaaatattactaaagtcttcatataggcttcttacaaagccagaaccattagctaattcatcggttaaaatgatttctgcgatattttttactattccgtcttcgtttatagtacattttgttatgtcggcaatttctatttctgtagggtcaacgtctaatcggtctgctaatacccgttgtaataaaaacgcagcagaataaaatccggaacgtactccaagtgactgtcgtgtaaagctaaacatatccaaattcagctcccgtggaacgcttgttggagatactttgaacatttctgtttttttgtaaatagctaatgctaagggttgttcaggttgagggctatttgtaacatatgaaaaatcattggatgggtttacaggcgtttccaatccatccataatccattgtttgtcaaagtcgaaacgttttcctaataatggattataatttcttacatgataatatttacccttataaagcctgtctccatttgtatttacacgccatgtaacatctttatctgaaattgtaagctttacgttgccgtatagtttatcttcaacattccggtcatctgtagttgattggtctgcatatattggtggcctatttgtgaccatctctgcttcgtcacgtgtatcgaggccttctaatagattagttcgatatgcacgtggcgattttattaagaattgactgaatgttgacttatctgtattaccacaatttggacatgccgaatctgtgggcttttcttccattgaaaatgtttgattatatccacattttttacatctggacatccatctacttagatagaagggattcttatcatcattatgatttgaatttgtaactgtttcactatttctatgttccgcctttcttataaattcacttgtgaacccaatagattggtatatagctttatctttggttttttgcattcctggagaaaactcataaatggccatagcttcaggtctatcaatcgcagaaatggaattattgtgtccgataccatgataaagatacttcactcctgtaggcatgccaaacattggaagaattccgccttcagcaaatttttgggatatgtcatctgtaggaatttcaggattattaattatttcatccagccgcattatgaatctatcatgattgattatccaatcaataaaattctgttgtttttcttttaaaccatcactaagcaaacaagacacaattttttggatttcttcatgatttgaatctatccaactaaccacaccttgcctatatatattccaattatttgttttaccgaattccccatgtatactcgatttctcttcattgttgaattcatttacacgaatagtcttgtatgcttgtcgcaaaatctctttggataaaagccgtttgtatatcctttcttgtttcatagttaggaaaggtgtaggaggattgtcccctgttatccgttgtggattggcaaaataaaattcgtcatgactgcgtccacggcaaaatgtaagaattaccgaatacgcttgcccacgtcgtcctgctcgtccaacccgttgttgataattgaatctttggggtggcatgttggcaagcataaccgcttgtaaagaaccaatatcaacaccaacttccaaggttgttgttacacttaacaaatctatttgttttacttttggatttccttcgtttttcaatatgatatttctgaaatgtcgttggcgttcaaattgatcatctgtttgccctgttaattcttcacaatgcaacctgattggatctcgttgttcataagctgctgtgtaagccaaataattcttcttccaaatttcttcacatattgtgtcatggcttatatttaaatttgtccgagaataggtgcaaatacctccggctggatgtaaatgtggtcggctgccattcttgcttatccagacagggtcggtaggcaacgcaactttcaaatataattcttttattaataatcctttatttgcttttaacgctccaacttcatttagaattttataaatactgtctcctaaaaggttgtctggtatagagtttttgttggcgacggcttttatgtaattccgaacaggtgcaggaaaataagtataatcagtaataacttgatttaatggatacatagagtagtcatgtttatatttatctcctaatatccttattaccccatctactatatttttaaaaatattagaaggaagtcccgttttcccagcatagtaatctagcctttctataggcggattaatagttacaaaaccaagccctgccccctcgaaggaatagaagaggcttgcaaaaaacatatttgctaattttgagaatgttccttcttttatatcttcgatgaatttatctccggttttgagccattctggtgggttatcaaacgatatcacattataccaatagtcagtaacaccatcagtcctgagagttttctgtaactttatgtcattaccacccgggttcatccctaaagaaactatttggcggactaatggcgcaagctgcgttgaatttacctcatcaactaaatcatatacttttataactcttttttttatttctgcaatttttttctgggctttagacttccgggatagcatattttggttccttccttcatatttgctatctgtaaatatttcttcaatatcatcgaatacttctttagttgcagagttattcgtattacggaattcgtttatcgcagattcattatggttttcaaaagcatgtaaaatatcatttcttaaaatgagtcttatattgagctcttttataagaagttcccttaaaacatcagtgaaatgatttctttcaattccgtttgctacttgggctgcatcttccctgctatctgaaaatactactaattttctttctttttctttatcaggtaattggtacatcaattctttagcaaacatttgtgatgttttggcaaaacctgttcggaatcctcttatggaactgattttattttctccataatgatggtctacgccacatgcagggcaaacacatggggttgccttatgggtgttaatagtttgtccatgtgcatctgttaaaaatgcaatatctaaattattattatcactcactattttaaaataaagtccttttatccaattatcaggttctttttctgcattcagaaccccttctttaatatctcctgaataaatgttcaaagacgcttcaacccacgatgcactatatttcccttgatcggctccctcaacagtagtttgacgccaatatccattgggccgttcatgtggtacaaattcctgtttcccttgtggccaaaagatagcgtattcctgatatgttcgacgttctaataatttgtgaggcgtcttttcgggaattccttcgatattgggactcaatgggagtagttctactgtttcattgtctactttcaaacggcttccgccaaaaagtgtggttccgcaattgtcgcaatatagcaattctaaaacacggtaaccacctggacttttgatacttggcgtagaagaaagccgacctgcagtcctttcatcatccttgaatttgtcttctacatccttcggcttgacagatgcccataagccttctatattccgtaaaaagtaatggaaacggaaacgaggaagcttcctgtctcctaattcagattcaagattacaccatcttgattcatcaaacaaagaccttgctattaataatcctcctaatgctttccggggggtgtcaatctcgccaaagataaattctgataaaatataagtatcttcatgattcccatttgctcttaatgagcagactgcccgttcttttccatctatcctgcaagcctggtataaacgttcacgtaataatagtttgggatgtagtaatgttcggaggagtaactctattggttgagcgtcagatggaatttcagcattcacaaattgggcaagttcacgtgcagctattctacatgtttcctgaaaagcaggactgtcgatattttttctggtatcataatatgcatcataaatccatataaatggatttgttggtaaaaagtgagtgtcttctggcaaaatattgacaggagtatttttaccatctacaattacaaagtcattctttgcatcagcaaccccaaagaaatcttgaatgaatgctaaactcttttgtccttcttcactctcatcggctactaatgaagcactggatgctaaaatccgtaattgaggatgtcctggatgtaatcctaatctatttaatactaattttagtagatatgctacttcagtgccttgtgttcctcgatataaatgtaattcgtctacaattaagtggaaaacacgatttttcttttcctgctctttttcttcgctatttaggttttgggaataaacatctttacattccaaccactctctagttttatcaaaaatttcactatcaatatctcgcataagcataatgcttaacatcgaatagtttgttataagaatgtctggtggggctacttgaatatcaaagcgcgtacgcatttctgcaccatcaattcgaggaaagaatgatatcaaatcttttgcgtcagattcagacatttctcccgattggagtttttctgtaatatattcatcaaccctattggcatcggtctcaattgctttaagttccttttttaatgtctctactttatagcggttaatgacatctactccattttcttttttcttcaattcaccagatacaggtgtcatgctattgtatcgtccaaaatagatacaattgtcgtgtatattatttttgaaccattttcgtgcatcatctgaatccaacgctttgcgcagtcgtgtcaattggtcttctaccaatgcattcatcggatagagaattaaagcacgtactcctgttggacgcctgttgtgcgaacgttgctgacatgtttttttcaactcaaaagttgaattgttaacaatatcagtgagctgtaaatcttcattccaccatttgtcgcataaatcttcttttatagtaggtatactccatgattccatttctttagataattgggcaaaaagaggtagtaaaaatgattcagtcttaccggaaccagttccagaagttataatgcagtgttttccttccattgctttgtttagcatgcgtgcttgatggtcatagagaggaatatttgccggaaataatccacattttacaagccctttaaatatgcctaattgggaagaggtcatacttcctccaacatctttaggagtaaggtcgtcaatctttttaccgctggataaataatctggaagtggttccatccaaggctcgcgataaagcactttgtcggtatctaataactgacgcctttcttcttccaatttatcgaaacgggttctaaacgcagtttctatataccggataaaattattcttaattgtatcgaatgattggatcggatttctcatattactctgaatttatataattgtactgattgttctaattttttaaataaattgtctgcaaatgttttgggaacgttttggtataactgatatgaaatgtaattaccatttatagaaattttttggaaagaaggtatttttccacttaataaaataagcgattttgcaataaactttggtaattggacgtgcgcaggtgctcctaatatcctactttcttcgtcgtaataaataatgttcttttttcggctagaaagtaatagaaactgcccccaatttttatccacatcataacatgtcgagttataccagaacctatataaccattcatagtgtatgttatattgtactaaggatagttccttatctaataattcaccttctgctgaaggggtaaatttcaacatatccatatcaaatacatcccgtttgtaaggataatcagtgccttcagtttgtcttttctcgtacatattgttacgataactgtttaaatcggcagaaaaacttcgtaatccccattggactatttggggttgtcggtatggtttgttgatgaatttgaaacaaatatcaaactgtaatgcaagtttctctaatgcttttagtcctgttgtggtgttgggacaattttgtgggacaagaattattgtatcaggaataagatagctttcaaagaaattatcttgcttgattattttgacatttattgattcatgttttgcatattcaaataatttctttacaaattcttctgtccgtgccccagttaaataagcttttatttcttttttgtcaggaatgagcattaattggggtttgttgactatgattagctgttgggactggtcaaaatcaacatatcctaagtaatctaaataaagtagggcgtatttctttacagttcttaagttagacttgtttaaggtgtcaaacatattttcggaactaaaaatagcatcaaaagaagttccaaaggtttggggattgcatctctctacaaatgaaagatagtataaaagaatgtttcctttgcgatgcttataatcaaatggactttgggaatagggttgggaacattgttgatatccccaaaaatctggcaagtcaccagcttgttgagaaaagttggatatttgaacattattacctatagcataatttccatttgaattttgtataatttcatcataacagttccgggtaggatggctattatctacaatacaatttacttccacattacatgatacaatctggtgtggataggtttccaatgcatcagttccgtcaacttttatcacaaaatcttcatcacacggaaagttttcgggaaatatccattcttctccaaaagagagaattttatccaagtatattttaatgtttgattgactaagtaaagcgtatactttggcggtttcctcaataccttcaattcttacctttggtaaattgtaattgagaaaagccctgtttttgactttaagtccacctataaactgaatttctaaatgagtttgtaattgtagcatttgttcgcttggatgatcttgttgtggttttgaaatactatacaaggtatacccttctggtactccatctaaatctacttctttaaaattcccatcagaaaaagaagacttgccccaattttctattgattctttctttgcattattgcaaagcagatacattttagatgttgggtatagcttatctgtttgtatccaataatcattggatattccatttacattattacggtataaaataatatcatctaaaactggtgcacttttccacttgttatatttatcttgtaagatcaaaaaagggttaaactccatttggattggacgagaaaaaccattagccaatgatgttacagaggaattattataattcagattatctggaaagtcattagttgaataaatgaaatagcaatgattaagttcttcatttactttatcgattgtaaatgcagaaaacaagcgggcgtatacccatgcttccttttcttccagtttttctccttgtttccgctcaatattccctttccatttataatgctcttcttttacaatgttgataattacattttgcaggtcgctatctccttcttttaatattttaagggtatttctcgacaatcctatatccgtgccatttttcagtagagcgttttttatactccctacaggaatatgtgtgttgggcataaatcccgctaatgaaaatagttttggaaggtttttgatgtcagagggtgtcaggatgcattgtgcgaatacttttcctacatgtatccaatttcggttcccaaaatgcccaacattgaagatacctatatctgtcttataagtagatgtagaccattccgataggtcatcccacaatttgtcaatgattccgaagtctgtggctccaatatgtctgttatttaagccattttcttttaaaaaattgtttaatcttggataataagcattcgctctataatcttcattattgccagtcaatggtataatgaaagctgtaagcattgctaaataaaaaggataagtaatttgggtcgcttggtctgtaatataagttccctctatttgcaagtctattttgttccatttgaatattccagttttcctatcattccacaaggtaaatagtatttcaacccgttttataattgacctcgatcttgtgaatcctgcataaccattcgataatgcaaggtaataatctgctatggcttcttctttagaagtaaatccaagttgatttatacctatttccccaatttctagtggtgaaataaacagatgcacatcttttcctcctttttcataattaaaaaagtagttgccaataacaatgttccaatcgaaatacctcataccttaatatataaaatgttattttattattgaaacagatatggcttttacattctccttcaatgcactagttgtttttgtcagctttttaactgaaagctgtggcttattggtgtaccaataggatactgttatttcactctttcgtgatgtttctaccaacaatttcccggttttatacagttttgcaagcacgacttttatctcatttattcgtttcatcggttaaatatttgatgtattttacaaatgtaatgatttgtgttgaaatgtttagtataaatcggtttttagttattaacattttaagcaattaaaataaatgagcaaaactgttaggcttgcaaaattgatattttgattgtttttattcctctttttcaattccataaataatgatttatcacttaaggtcgcagcagagaatcaactattttaattttttttcattttcttcctccacctttgaaaccctctcatcaaactttcctcttccaccgactctgccatatcatactttaccacaaactcatgcatcgactttatatacatcaccccatttttgaacttattctccaacaggaatgaataaagctccgctttcatttccacctcaatttccttttcgataataaagatactgtcctggccgaaataattataaacttccggattcttgcccagccttgggctgggaagaacaaaagtgatatttcctgtctttttccaggagacgccttgcggatgaggaacggataattgatgtaagaagtgataaatgggagtgaggtgggagaggtggattggaatggggagccttgacggtggattgttatgtgatagaagttctaaactttgtccgtaccggacatacatatacctcgccagatatggcttgatggcaaacgtgactgtaaccatgggatttgaattttgaattgttgaaatttgttgtatactgattgccgcttcgtgcggcagattccgtcgtgtttgttggaaaaaatcccatgggttacggggacggaattctaattcggtaagaaattgaaattcaaatggttacaaatgccggtttttcctttaaaaccaacggaccgttcctttaaaaggaacgacccgttgcacaccgaggaatgacctcttccttttaaaggaacggacggctccctaaaatccatcgtgcaaagctatgcctaatattctgatttttcaaaagaaagaatagcggtattctttgtgttatgtaaagaaatattataaatgatatacatatctaatttatgcgtatgcatattggagatatgtaataaaaatatactgattactataacgtgtattttaactatatttatcagataactattcttaaagtggaaaaactttttattccatttcttgtttcttgcgtaacaggcggaaaaatagttctgataagtaaggtgaacttcgtacttttacgtctcaaacaaaaaaagcaaaatatgataacatcagtgaaacttatgctgaacaagagcaggatattgaataatggcagttaccctttagtatttcaggtgatccacaatcggagaaaaaagttactgtatacaggctaccggatgaaagaagaagtctttgacgagtcggaagggaagattatgaatggtgtaggctctacttttacggctacagaggtcgtaaaaatgaaccgcgagctacggaagatgcggaatcagattgatacacggatcaggcagcttgaacggacaagagaagaatttacagtggaggatattctgactcaaaatgcttttggtacaggaaaaacgcagttttatttattgcgatatatcaatgcgcagattgagcgtaagcaggaactgaagaaagtgggaatggctgcggcctacaagagtacccgttcgtcgttggcaaaatttataggtcgccctgatgtgcggatgtcggaggttgatttagggttcgtcaagagatatgaggatttcctgtatagtaatggtgcttccggcaatacggtaagttattatctgcgcaacttgcgctctttgtataaccaggcggtagtggacggttatcatccccgtggcgaatatccgtttgctaaagcgcagacccgtccggcgaagactgtaaaacgtgctttgtcacggacggatatgcagaatttggcggacttgaatttggagaatgaaccagaactggaatttacccgcgatctgtatctgttcagcttttatgcgcagggaatggcttttgtcgatattgtccttttgaagaaaaccgatatttgcaatggtgtgctgacctattcccgtcataagtcgaaacagttgattcgtatagtggtgactccgcagatgcagggcttgatagataaatataagacagaaaatgagtatctctttccgataatcagcggtgaatatgcttctggatacaaacagtatcgtttggcgttgggccgtattaaccggcatttgaagaaaatcgctgttgtagctgatattgaagtaccgttgacgacatatactgcacgccatacctgggctaccctcgcacgtgactatggagctccgatttctgtgattagtgccggacttggacacacttcggaagaaatgacacgcgtctatttaaaggattttgatgtattcatgctcaatcaggtgaatagcatcgttacaaacttatccaaatgaaataattatttgtaatataatctgttgaaaattagaatatatcatatttttatttatctttgcaatattgtaatctattccgtaatagagatgcatattaaaaatacctttgtttcttaatatatttcacgctgcaaagtaaatgaaatttttcattattgaatttatcataaagtccaataatttattcattttgtacagatagagataataatggctaactcgtttgattggttgcctgacattgctctatcagttgtttgggggtacatccgaaatgttgtttgcagtaacggttgaagttaccttgcgaatcaaatcccaattcttcaatgatatcttttatacatactcccggtttcgtcattttttccaatattctttggttcttttgtttcagcatccactgtttagctgtcataccaaacacttcattgaatttgataaaaaaacagcttcttcccatattcgatagtgagataagctgctctatattatctactttggtatgattgtgcatgacaaaatctttaaaatccacttcttttccgataatggggtggaataatgctgcaatctcctgtttttcataaaatcctcgtaaaagaaagaaaaactctcgttgcatcagcccgtgtaagtgtgcgcaactcattccgtttttgatgcagtgagttaatacctcgagaaatagtgttagtggatagcgtattttaattggtgaaaagtcatatttaatgttgttgcatacatttgataaagactgtaatatgagcttgtcacagttctctgcaggtatatcgaaaaacatggagagcaggcttgaatcggtttccgcaaatccttttagccgggaagaacgagggatgagtatcatttctccggcatgaaacagcttgttatgaaactggttgcaacaaatggtgaaatcgcctttcagaaagaacagaagataatttttagttgtattatcttcttcaaatgctgcattcttggcgaattcaagatatttgaatccggtttcaatcgttgtcatgtagttttgacatgactgatgttcttcaatgtacaaaagttcgctttttgtatgttttgtttccatggcaataactgttttgattgtttagtctgttacttatctgtttgtttcacaattgtttcagtatctatttttttaatgaattatatatcagaataatattatttattttgtttgttatgattcattatattatgatattgaaacattctgttattagtttctgtaatataattcgttgataattaaatgtttattatttatgtgtaattatgcatctctattacggaatagagatacataagaaatagtttgaaaagactgtataaaatgaatgattgtataagaaataaagccggcatacttattggtctatttactttgctaggatgttttgcggttagagcacaagatatagcagtaaaaacgaatttactttatggcgggttgtcacaaacaccaaacataggggtggaatggggaatatctcccaaactgactgttgacttgtggggagtctacaatccttttcctttgggtaagaatggttatggttccaacaatagaaaaatgaagcattggttgatacaatcagagcttcgctattggctttgtgaacggttcaatggacatttctttggcggacatttgttttatggacaatataatgtcagtaatattcgatattggggactaggtgactttagaagacagggaaatcttgccggattcggattcagttatgggtatcagtggattctttcaccacattggagtatagaagggacattagggatcggctatgcacacctgcattatagtaaatacccgtgtaaggaatgtggtaagcgtttaagcgtaaacaaccgtaattatttagggcctacacgtgccgctgtatctatcatatatttacttaaataatatcccaaatgaatagttttcagattataatactttccttttttatgagtataacggtcatgtcagtttccgctcaaaataatgattcgatcaagatcaataatttttctatagagaagaatgctcaaggtgattctgtgagtttgagatttcatttgatgattgctcccggcattacaaaagcaaatgatgagttgttgcttacacctatattgatagatataaagggaaatcactcttttgctttccctgtcatacgcgtaaatggcaaaatacgggagaaaatagttcgaagacaaaaagtgcttcactcatcaaaagcagagaaagacttaatatatacagtatccaatcggcaatggaatacaataacatgttcaactccgatgttagccaatcaactttggatatggcaggcaaagttagtgttacggcggcaacttggaaattgctgtatgaaaaaggagttggatatggtggaattgtttacgtggagccggacggatggatattctattgttaagccggaaataaagaataaggtggaaataccggaaatgttaccgcataaatgtgctacggaagtactggctgaaacagagaaatttgtagaacccatagataactattcagcgggtaaaaggattctggcgggcgagcaggaaggagcacagattgtttatttcaagcttgcaaaggcagagatagatagcaattatctggataatgagagagtgctggaacatatcattgatgtaattcgccgtattagtgaagatcccgaagtagagatagctcgcgtagtgctattggggctttcctcacccgagggggcttttgaattcaataaacaattgtctggaaaacgagctgaagcgctgaagcaatatatagccgaccggattgctttggcggatagttgctttgcgcttgtgaatggtgatgagggctgggaagaactacgttataaagtggaacactctgatatggaataccgtaaggaagtattgaatattattgattcagttccgataatgaaaggccgtgagggacagttgcaacgtttgaaaagaggagtgccctatcgttatttggaagaacacttctttccgcaattgcgtcgagccggatacatcaaggtgtattaccggatgaaaaatggaaccatataaatctcaatatataattatttattttttaatcataagacaaaaatgagaaagaattattttctaatcggagtatttgcgctggcaacaataacgtttgctgcttgtagcagtgaggacaagctaggtgaagaaagaagcgatgacaatggtaataccgaagtcatagagggagagcctacttgggcgaagtttacatttaaactgggcaaagatggtgttgtagcacgtgcaacgggtgacacacatgaaggtactactacagaaaaaaacatcaaaaatctgcgggcttatatcttcaatgagtccggtagctttgaagcaaagacggataatgctactgtagatgaacatggcacggagcacactgctgtattgaaactaacttccggtaaaaagaaagtgtatgtagtagctaatatgcaggacgactggattacgtctaccactacaactgctcaatttgaagctgttactttgacacattgtacgaaagcaggacgtattgcccataccaaaggtgtagaaacggcagttgctgtatcgcgtgtcggtaattttgataaaatatccggtaatgggaatgcggcgaccaatggtttcctgatggcaaatgtattaaaggcaaccgaatacacattatatcccgggatttctgctgaggattgttcgaaaccggcgtatgatagttcggcggaaatgaagaaaaacaatcatttggaggtgttcatatcccgtgctgctgctaagttgcaggctacttatgtaaatgcggatgctttgatattgaaagatagtgaaagtaatacattaggcaaattacttactccgacttttacggttcgtaatcttccggttcagagctatatatttctgcataatcatgttgatggtttccttacgccgttctatacaatgactaatactagctctacatttgcagatttcgctaaatattatgacgaggtgaatgagcctaatttggatttgaaagcaagtgctgacggggaagctatagagtctatatatttgccggagaactccaatcagacaccggtaaggggaaatactacttatgtgttggtgaaaggtgtatttgctccggcggctaatgtgatgattaatgctgttgaagtgaaaaatgatggtggcaatcttagtatcgaaaataaattagacggaactgattatactacaggaggaaaagatgtaccgccatattttattgtcccggaatgggaaaatcagatttatacggctcctgcagactttagtggaaacttggcaaactatggcttgggcatgattttaaagacttatttgaataaagccggaaaacagaaatggttaaatgcagtagacgagggaagtgctgtagacgaaggtgatatagagaattctgtaagtgtatattatggaagctcattctctacttctgaaggtatttattcagttgttaccatcaagaaatattcgcatcccaagaatgcactaccgggctataaggaaagtattgaaggaacaatacgtatttttcagtacaccggaggtacttgttattatcgtgtgaatgttgaagataatatggacggaaagacggaagccaacaacctgttctattcggtaatgcgcaaccgtttttacaatgtaaatatctcaaaaattacttcaatcggttatcccgatgatgaagatgttaccgtggacccgacagatcccatcaaccagaaaacgtacatgcaggcacatatcacagtggaaccatggacgaaagttgaacaggatgcagaactgggaatgtaattgctattagtctgccggttcattaaaaatagattttaacggattcttttgccggggcattgtccccggtaaaagaatctaaaatccctctcaataacaatttaacatgcatagtacattttaccggaaaagaaggatggtggcatacatatcaatgctattatggcttattacaggatgcgttaatgaagatttttccgattgtccgcagggaagtttccaggtggctttcgaatatgttcatcacacggacaatacttgtcccgatcgcttcaacattgacgtacagcaaatagacttgtatgtatttgatgcagccggatgttttttgaaatgtataactcgtaaagggacgcctttcccgaaagaatttcggattgacccggaactttctgccggtagctatacgttggtggcatggggaaacttgactgatgaagtgactttacaaccggcctttattgccggacaaactacgcttgaacaagcgttattatcactcaacgcagctgaagaccgtagcgtgaatcatagactgactcctgtttttcatgctatgaaacaagtagaagtaaacgatgtgaaggaacacactgaagttctttcacttataaagaatgagaatcatttgcatctgaatgtgaagtggtttgaaaaaagcggaataccatgtattcaccgctgtgcggatggcgtgcgtgtccgtgtacttgatcccaaaggggcgacctataaatttgataattctgtagttgcttcgggcaacgaattgacatattatccatatcagggcgtaaataatgatgcatggaatcaatttgcaggcgttttttctttgatgcgtttggtggaaggggaaaaattgacgctactgatagaacgtttgatgcaggacggcacagccaaagaactctaccgttctgacttagtcgaacttatccggatgcatccatatacccgcatccagtcggaacttgaccggcaagatgtgtatgaagtagaaatatcgcttatagatgatctggacggtgacacggatacttatatgcaaacggctgttaccgtatcagggtggacaatcatattgcaggatacggaaatgtgatactttataattaaacgagagaatgaaactgaaattagtttatatatatagcttcgttgtgacattattatatctgcttactgcttgtactgacggaatagaagcatcttccgatagtaatggccagggggaaggcaaggaaattcctgtcagtatcatgccgaaacttgttgcaggggatgaaaatgaggtatcacaattgcgtgttatcattttctcgacacgtacttccaatccttacggtcctaaagttttagtcagcaatcaattgatagatgtaaatgaagattatgttgccattacctatataggatacaatgatatttatgtgataggaaatgaaccggtagatctttcgggaatcaatagccctgaagaattgaaaaatattcagatgaatacggaaagcagcctgagtgcttcaaaatttgtatttttccggcagttgctcaatgtgaatgtacggagtaaaaatgagatatatccggaaggggcatccgcttctgtttcaaaactggagataaagttgcaacgagtgattgccaagttaagtgtgaagtttgaccttagtacggagatttgtgaaaatggaaaccctacaggtgaattcgttaatcttgagtctatggagttacttcgtattccaaagtatagttatctggcttcctgtaaatacaggatagaagaggggtttctagataaccgcgttttttcactagaaaatagcagtgcagaacagaatcatttcacatggtcatccggtgatatatatttgccggaatatctgccgatggatgagatttacagaatggtattgcgcattaaagggacatcaagaggaatcacccgtatatatactttgccgattggtgatgcgatgaattcaattgattcacattctacagaatggaatataacccgcaacaggcattatagtttgaatattaaagcgattaccggttatggggaggagtcccttgaagtgaaatccaacgtttccggatggtcggaagtcaatgttccgattgaaataacgggagctagttttcttgcagtcaacaaaaagacggtcgaagtaaagtctttacgcttttactcgtatgtgcgttttgcttgtaacgctccggttgaagtgaaacttcccgatgaggtgacaatcggtaatcaactgcagatgacaatagaatatgatgacgcgacaaagaaaagcggtcgcgtcgggttcagacgtggaaattggaatactggtaatgatattatatatgtaactacattaaaatcgggtaccgcatctgttgaacttaatctgcaactttatagatctgaaacaattcgtgtcggaaataaccttgttacttgggctgaagccatgggatattgggaagaggctaactggatacgtacgggtatttataatgatgagttttataaaagagccacccgggaaactggatgtagagcatattatcctgaaggagtaaatgagaatgatgcaacaagagggaaaggatgctggagattagctaccatacgtgaaaattgggcgattaattctgctgaagcatggtgcatagaggaacatgatacaaatggcagaaaggcatatgtaagttacggatcgggaaatctcatagacgattataaagagaataaaaaatatcgctataactgtacacttgatgttcgtcctcctgaactttcagattttatagtctcaagttcagatgtaacgaatgtcacgaaggaaaatgcgtcctctatatgtgcaaatttaggcagtggatggagattgcctacaggaaaagaaatgaattatgttttcctgaatgccggaaccaacgggcttcccaataatttcttttcggacagttattggggaaagaatgaggatggtactttcattgtagcaacaatgagtgatccggacggaagtgccacgacggatgaattgcgaaatgggagacatacggtgcgttgtgtgaaattacgttatccccctgttggataagaaaaatgatagatatgatagtaaaaaagaaatatattcaattagtcctgtttgtattgcttttctctttgggggcttgcaatagtgatgaaatgtcggatattaacgatacaacagaagtacaggagcaaatggttttgaaactaagtgtgcaacaagagtctgttgtgtatacgcggggaacaggtacccctgccgatgaagcaaaggttgaaagtatggattttctgatattcaatcatgacggaaaaattgtttatcatcagcatcctgtattggaatggactggaaatgaatataagacgacagtaaacattccttcggcgacaggagagcatacattgtatctgatagctaattatccgatggaagcagggacaatacatactttacaggacttggaaagcaggatatgcacaagtacgaaagcacttgtaaaaccaccctttgtaatggctaccaggcgcataactctttcatcactcaacatgatagctattcgtaatgcgatggaaagtgacggtagcaatggtttcagtttaaaacggaatgttgcgaaattcagtgtgggagtggcagacaacaattttgaattgatttcaataaattggttgggttgtcctgtgtcagcctctgtattggcagacgtggattataccagtccgtccactttgtccgtcagtaaccttgctccttcgtcaaatcctatttatctgtatcagattcggaaaatgggtttggatgcgcataaaggatttcacatcgttgtacatggaaaatatacggcagcggatgggacagaaaaggaaggatactataaactccgtctatgtacaatagatgatgctacaggagaaaaagttccgttgacttcaattgtaggcaatgattactataaactgaatatccggagtgttacgggatttggcgctaattcattcgagaatgcagaaaagaatggatttactaatgatatggaagcattcatgttattagagtataatggtacacatgattatcaagagaattatttgcagaatggttatcagatgggatttgaaaattcccgttggattatatacagtaatgaaaccttgaattcttttgtgttaggtcatttctaccggtgcatccgggatgaatcattggaaggttacaccatgtttgatccggattatcctaatcttcagcgtggattgataacggtgaaagcaaatgggacagaaataacgggggaaacagtttgtaatgatacttctgataatcccgtcgagatggacttgtgtttcacggaatcgagtgaagtcgcaggtacggaatactcttttacgagtattatccaatatggtgttctacaaaaaacggtaactgttgaacgtcattcctctatcggtcggtcatatacagtgcttcctatgttatatacgaattacggggaagtgttcgattcatgtgattggatcgggatagctgaacaacggcacgaaggtgctattacttatccgcagttagactctgctaatgattacatttttgtccatgtaaaggaaaatggcacaggcaatgcacgtgaaggaaaggtgcgtctgtttggtaggaatggatattttgaacttcggatacgtcaggaaggataattcaaatagtgttaagagtgaaaggagatatgaggatgaatatattaaacgatattttggaaaaagaaggtgataatcgaggctctgtttatttgtattgtctagaggattcatggaaagcattcggatattctgctttttatctgtctttactttatccggggatgaaaatcgtgaaatatgataatccggatattatatgcttttttgtgtgtatatcggatgactgtctgatggaaatattcgagatgagccggatatatgtcgggaatgaatgtatagagatgaaagtgccggaaaggatttgcggtggagaaaacgagtatgtcaaatggtgtaatgaattgtgcttgaacttgtagaattatgaataaacgaagattaaggttattacaccttttaagattggtaatccatcagaaatatataagacttctttatattactttaggcgtgtttttacttttatgtacttgttctgccaattctggtgaatcaaatgctatggcaaagcaacaaaaagacagcatactgatagagcgcttttgggatacgtatgattttacagatactatccggttaagcagctctgccactaccgaaaggatgttggtggattatctttctcaattgtcggaactgacagaggaaagggcttgtgaaaatatcaggagattggtgttgaagactaaagttaataaggtggtaaaccgttggtttctacaacggttggagcatcatctatatgaacctgattcgtcactacggaatgatagttattatatttcagtattggaggaagcattaacatccggacatttagatggaatgatgcgtatacgtcccttgtatcaattgaaaatgcttaaaaagaaccggatagggataaaagctgctgattttactttcattctttctacgggagaatttcaaaaactatgggatgtttccgctaaatatacgttattactgttttatgatccggattgtatttattgtcggcaatcaatgatggaactgtctgaatcatcggtaataaattccttcttgcaacatagtggactatccctatcgcaacttgctcttgttacgatttgtacggaaggtgaaatggatgcgtggaaagaatatcagcagtctcttccttctgtgtggataaacggttatgatgtcaggaaggtgttgactgaaaaagaactatattttttgcgttctcttccttcgatatatttgttgggagaggacaagcaagtattattgaaagaaccctcttctataggtgaagttaccggttatttattaaataagtatgatgatatataatagtggcataggaaaaatggaatcatgacttttccgctgcctgtgaaggtagcctattgtttgttttgtttgtgtgtgcatctttttcccggtggggaagaaggtgcacttttttattatgatatttattagtttgaatatatttgtttatttattattctccccggctatcggttttgtcgctttttcttgcttttcgtcgttgtcttatcgtttatttggttcctctatgtcggttgcgtatatctgaaatgctttttagtacttttctgatgaggctattaggtgtcgtttcatctccgtggaagatgctgcatctttgcatcgttaacgttagcgaagtgataattaaaacagtatttatttaaaaaagaaaagtagtatggctattagatttagaagggtgtctcgcctgtgtgaccctacaaataaagaagcaggaaagaaagtgtatccggtgatttcttatcagtatgatacgagtgcaacgttggatgagtttgcaaaggagattgcgtctgcttccggtgtcagcgagggtgaaacgattagtgtattgaaggatttccgtacgttattgagaaagacattgctgggtggtcgttcggtgaatatcgccggtctgggatatttttacctttctgctcaaagcaaagggacggagaaggcggaagattttacaatcgctaatatttcagggcttcgtatttgttttcgtgccaactcggacattcgtctgtttaccgggacgactacccgttcggatggattgaagttcaaggatttggatcatattaatgattcgggtagcattggtgacggttctgatgatggaggtgaaactccggatccggatggtggttcgggtggtaatggtgaagcaccggatccggcagcttgattcataggtcgttgagaactgtctggtttgtatggaatggggcttcggcctcattctttctttataactacgtaaaaatataaatatgcaaataactacaatccttgcttttattaccgctatgggtggtttggaagctgtgaaatggttagtgaggtatatcacttgccgtaagacggatgcacggaaagaggaagcgtccgtgaacagtatggaagaagaaaatcgccgtaaaaaggtggactggctggaagaacggctgactcaacgtgacgagaagatagacgggctttatattgaacttcgcaaggagcaggaagagaagattgactggatacataaatgtcatgaagtggagttgatacagaaggagtcggaagtgaagaagtgtgagattagagggtgcgtgaagcgtatgccaccttcggattattaactggtgcgtttgaactaataatgaattatcatgagaaatatagattctatcatagtacattgttcggctacgaaagccgggcaggattttactgctgcggatattgactgttggcaccgggaacgtgggttcaacggtatcgggtatcactatgtggtccgtttggatgggaaattggaaaaggggcgggatgtttctctggccggtgctcattgtaaaggttggaatgagcggagtgtcgggatatgttatatcggtggattggatgcgaacgggcgtccggcagatacccgaacgaatgctcaaaaacgggtgctttatcagattattatggatttgcagtgggaatataatattctccaagtgttgggacatcgggatacttcaccggatttgaatggtgacggagtgattgaaccttatgaatatgtgaaggtttgtccctgttttgatgtgaaggagtttttgaggagtgggagggagttactgtttgtgttgttggtggctttggttgtgcctgtattgctgtcgggatgtaggagtaagaaagaggtgataaatagggagagtgaagttagggttgattcaagtttaaatagtagctccgggaaaagtcttgttaaaaataaggttgcttcagaaaaggattcggaggtggtagaagagcatatcgaacaggtggtgtttgtgtttcctgttgatacgcttggattgaaggctgggatgatggtgaagactgtggtggataggaaaaacgttaatgaaaaacaacttcttcaagaagtgaattcacagtctgtgagtttgtcggatatgagttctaagacagagattcataaaacgggagttgagaaaactactaataggataatcggaagtgggtattggtacgggattattttgctggttttagttattgtgtgttggatttatagatcgatgaaaaaggctatctgattccttatcaggcagacgggagtgaattagtaaaagtaggggtagaattcagtgcggaaaaaagaaatatagaccgatggctgtactaatcgataaccatgttgctaaagaatttatagagccgtttgagattgttcaagcggctcttgttttgcgggtagttcttcttatcgtttgttttaaatccaaatcacaatctctatttctttatcagttgtgatcttttccttttttctgatttccgctttgagaggaagtaaataagtatcaagtttggtgtcaaaccagattgcggtttcccattgggtattgccgattttggccgtcatcttcaaccgtccccagccttcctctaagaatccgagattctctcttatttctttggacatctctttcggcaggcaggctatgtgtcaaccgcccgttccaacggtcgatgagtagttccaaacttttgtggtaaactcgtattttattcccttattttctattgtacaaaaatagaaaataataggagattagctataattttttcttttaattaattttcgatgtttgtttgaatacacatctattataggaattggcaactgggcaaagtggtagaataagtcaaagttaacttgtgcatagcccttgtggttgccacataaagcatacttttatcaatattggaatgatagttcttgtcatttgtttgcggaatgattacttcgtcaaattccagtcctttcgccatatgggcggaagtgatgataatccctttcacataagcagaactttgatttgacaaaagtgagatgtcgtttgcatatatctggagtttttgaacaagttcttttgcttgggattctgttttgcagatgatccctaatgaggtataatgggagttcctgaaggagtttactaaatccgcaataccttggatctcttcttctgtacttttgaatggaagaatcttggggtgttctccatgtctcataatcggttctaattcattgttcgattgaattttttgtgcaaaactggtaatctcaaaagtagaacgatagcttttgcaaagtttcattatttctcctgttacaaatgctttttgaatcataccggcagtggaagatccataaggattgacggattgggaagcgtctccaagaattgtttttcgacacggataaagtttttgaatcactttgtattgtatgggagaatagtcttgcatttcgtctatcagaagatgtttgacataagattgggcgttgttcccatctaatgcgatatgcagataagccaaaggagctaagtccgcatactccagtatgcgatttttgcgtgtcttgaacatctccggttttccgatccattcaaaaaagtctttatagatttggagatcgttattgcccgcgaacatcttttttatctctttctttagttggtttttctccggagtgctaactgtgagattatattgtagttgcatcatctccagaatgtaatctgtcatagtctcaaatcgttgacgtatgggatagcggtggaatcgtttgaactgttcgttaataaattcggcaggaacggtgatgtatttggtgagttttacgtctgttgctttgaaatagttgttttccatgtaaaggatgaatttgtcaagtagtgatataaactcgaaggaggctttgtattgtattcgttcgataaagtcgggtgtcgggttttctaatagttccgtcacttggtcgaagaaattctggtgtttatatttgttgtcaattacatccgacagaatttgctccatgctggtttcgggaacggtctcttcgccaagttccggaagtacattagaaatgtaatcggcaaatactttattgggggagatgattaatatgtctttggaagaaatctgtcctttctgtgcataaagcaggtaggcaatacgatggagcgcgatagaggtttttcctgaaccggcaacaccttgtataatgagtacagaagcgttttcattacggatgatctgattctgctccctctgaattgtcgtgacgatgtttttcattttgttgtcggcattggaacatagttctttttgcagaatatcgtcatgaacagttacggaactttcaatcatgtactccatttttcctttgcgaatacgatattggcgtttgagtgagatcgccccgttaattttgcctgccggagaggagtagaacgcctcgcctaattcatgatcgtagaacatgcttgaaataggagctcgccaatcgtaaatcagattctttttttgattgaggtcatagaaagtatgtattcctatatagattggactaacttggcttttgtctttcttttcctgaaagtcgattcgtccgaaataggggatatccagtattttgcttagtcgcctgcgtttgtcaattacattttcacctaatgcaaaatgatttaagatgctttctcgcatggaacggatttcgtggggatcgatatccttgttcgaccatagataatccttgtattcctgcagggtgtctatatgctctttgacggaagtactggtggtgttaatcgtatcatggatggtggttatgacttgctgtaaatactctttttcctgtttctctgtttgattgaatatcataatctctttttagttgtatgatgaagaattgaaattgcggacaaagttagctcaacccattaagggattaaatagttatttatagctatatatgtatcctttttcctatttttgcatacttacttaataaggaaaaagatgaatattcttgaattggcaaaacgtaaccagcagaaagcttgggagattatagaggatacccgtattgttcggatatgggaggggattggtgccaaagtgaatctggtaggttcgttgcgtacaggattattgatgaaacatcgggatattgattttcatatttatacttctcctttggatttgtctgtcagctttcgggcgatggctgaattggcggaaaatacgtccgtaaagaagattgaatatacgaatttattacatacagcagaagcgtgtatagagtggcatgcatggtataaggatatggaaggagaactctggcaaatggatatgattcatatccaagaaggctctcgttatgatggctattttgaaagggtggccgaacgcatttctgcggtattgacagatgaaatgagactggctatcctgaaattaaaatacgaaacgcctgatacggaaaagattatgggagtggagtattatcaagctgtgattcaggatggtgtacgtagttatccggaatttgaggaatggagaagattgcatccggtggtgggtgtggtggaatggatgccctagccagattggatcactgtgcggggagaaagattgcatgtattaacttagcaatccactctcttgtcctaaacgaatggcttcaatggaattctgtacacctaacttccgtaacagattttgtcgatgaatattaactgtatgaatgctgatgcatagtttgtctgcgatttctttacttaacaggcctttttgaataagacgtaatacttctatttcccgattagtaagattggtagaaggcattagcgatagggaaggagaaaatatttctccattctttagattcaggacggtacaatctacggtttcagaggctttttggtcgggtgatatgtccatgtttcctatgataagccatgctttaccgttgcggtcctgttccaatacctgatgtctgctggtgacacgtatgtactgttgtttcgcattgagcatacgaaaactgtaaatgttagaatagctattccgttgctcaaaaggcaggctatagatgaattggcttagtgtgacctgtaatgccgccagttgtgcgcgatcatcgggatggatgcgcgattccagataatcaccctgtctttctaatgtttctatcttgtggctgtcgtatcccagtaaatcaacaaaattcggagaggcgtaagcatatttgcatttataaacatcaacaacaaatgtacagttacgacccattttcgagagttgatgaagcatggatttatcccgctcccatacggcatagtcaatgtcggtagcagatagatgctgctttgcccacatttcttctctagttgtagtgtttagtttcattctcggatatatttgttgggtgtatcttaataattgttctggaacaaaaatagatatattatgggaaatggtcaagaatgaatgagagaattgctaattgtgactgttttgtgtgattgacatgctaacaaatgataataattgagcttctattgaaaaatatagaataaaaacatagttatctaatttattgtgttacctttgttcccagagtttgagttacgaatcattattgtgtagttcttctttttaatatattattagtaagtagtcctcttctgtaattatcctcctcactccaaaatagtatttattttaataaaatttttagatgaacatttacatttcaggtttaagctatggcacaactgatgccgacttaacaaatttatttgcagagtttggagaagtttcttcagccaaagttatttttgatagagaaactggtagatccagaggatttgctttcgtagaaatgacgaacgatggagaaggacaaaaagcaattgatgaactgaatggagttgaatacgaccagaaggttatttcagtaagcgttgcacgccctcgtactgaaagaccgtcaaacggtggaggccgtggtggttataataactctagaagatattaatatccgaataaaagcagaagattctgtcttctgctttcatttaaaagctgtttccgtttcatgattcaacgggggaatctctactgaatagagaagacgaaaaatcattttacatttaagttctgctaattctggctcttctatgcaaaattaggaatttctaatcctgtactttccattctgaaaatagatttattaggcttttttgtaatacaatactcttgaaatagccaagggcatatagtttaataaattatccaacaaggtaaatcattcgtgacagaaccaaatattgagcacttgaataaagtatgctcacttctatctgtctgttttgccaatacaaaataaaacatatgaaatcgttctttataggaaatattgaaattaaaacacctgttatacaaggtggaatgggagtaggaatctcactgtccggtctggcatcagcagttgcaaatgaaggcggagtaggcgttatatcatgtgcgggtttaggattgttatatcccaagggaaaaggctcttatccggagaaatgtataagtggactgagagaagaaattcacaaggcacgtacaaaaacagaaggtattattggcgtaaacgtcatggttgctttatctaattatgccgatatggtgcgtactgcgattgaggaaaagatagatgtggtattttcaggtgcgggacttccgcttgatctgccgtcatatttgaccccggaaagtgtaaccaagttagttcctattgtatcttcttcaagagctgccaaggttatttgtgacaagtggcaaaaaaactataactatctgcccgatgcaattgtggtggaagggcctaaagccggtgggcatttaggatttaaaaaagaacaaatacaggatcagcattatgctctggaagcattgattccggaagtggtgatgattgcatccagttataaagaacaaaagcagattccggtgattgctgccggtggaatttcgacaggtgaggatatagcacattttatggaattgggagcttccggtgtgcaaatggggagtatttttgttaccacccttgaatgtgatgcttcagaaacattcaaagaagtatatattcattccaagtccgaagatgttcttattatagaaagtcctgtcgggatgccgggaagggctattgatggagaatttattcacaatgtgaataatggtttggagaggcctaaaagttgctcattccattgtataaagacatgtgattatacaaaaagtccttattgcattattaaggctctatataatgcagccagaggaaatatgaaaaaaggctatgcatttgctggtagcaatgcctttctcgcagaaaaaatcagtagcgtaaaagaagtaatggctacactggaacgcgagttttttttagcaacccacagactggcttaatgattgaaactctgctttttcatgattgaaattgtccgggtttcccactatatataaaactaatcgctgtttgagtacagcaaaaataacatttatgacatttaaagaattaaatataaccgaaccgattttaaaagcaattgaagaaaaaggatatacagtaccaactcccattcaggaaaaagcgattccgcctgcactggcaaaaagagatatattaggctgtgcgcaaaccggtaccggaaagacggcttcatttgctattcctattatacagcatttgcaactggataaagaggttgccagacgtcagggaattaaagccttgatattgacgcccacacgtgagcttgccttgcaaatcagtgaatgtattgacgattattcaaagcatactcgtattcgccatggagtaatctttggtggtgtaaatcaacgcccgcaggttgatctgttgcgtaaaggtattgatattctggtcgctactccgggacgtttgcttgacttgatgagtcagggacatatacatttggacactatccaatattttgtattggatgaggctgaccgtatgcttgatatgggatttatccatgatattaagcggatattgccgaaacttccaaaagaaaagcagactttgtttttctcggcaacaatgcctgattctattatctccttgactaagtctctgctgaagaatccggtgaagatttacataacaccgaaatcgtctactgtagattctatcaagcagctggtgtattttgttgaaaagaaggagaaaagccagttgcttatttcgatcttgtcgaaggcggaagatcagtcagtacttatcttctcacgtactaaacacaatgctgataagattgtgaagattctgggtaaggctggaattggcagccaggctattcatgggaataagagccaggcggcaagacagtctgcattgggcaactttaaatcgggaaaaactcgggtgatggttgccactgatattgcttccagggggatcgatattaacgaattacctttggttatcaactatgatcttccggatgttcccgaaacctatgtgcaccgtattgggcgtacaggaagagcagggaatatgggaactgcacttacgttctgttcgcaggaagaacgtaaactagtgaatgatattcaaaagttaaccggtaagaaactcaataaggctgatttcactatttgaaggtaagcacttacattatttattcattaaaaatatagtataaactaaatattatttctatggcaaaatccatgacagtaggtaaacgtgaaaatgaaaagaaaagaatcgctaagcgcgaagaaaaattaaagaagaaagaaaataagaaattatcgggcagctcaaacagctttgaagatatgattgcttatgttgatgagaacgggagaataacctcaactcctccgacagagaatgtcagaaaagaagagatcaacccggatgaaatagttatagcaactcctaaaaaagaggatgaagagccaactattttgagaggacgggttgagttttttaatgagtcaagaggatttggttttattaaagatctttccgatgcagaatgtttatttgcccacgcaaacgatatttgtgttgtataaagcattgtatatcaatatgtaaatttttgaagaatatttttgggggacaaacgggggacaaaatttcgcataccaaaagaaagaaaaacaataaaaccacttcccaaaaaaacgtgttgaattgcaagaggcacggtttgtccctcgcaattattttgctttgcctctcctcgtccctcggatgtagagttagattctgtattatttcagaaacgccaaaagccatagtcttgcataccaaaagaaaaaagcaataagaccattctcgaaaaagcatgctgaaatgcaagggacataatttgtccctcgttgtattgttgtttgtccctcgcttgtccctcggacgaaagttaggtttgatgcagttaccaataacgtgagtaaagtaatgattgaataggtttagtttggtttttgtatatctaatcaagttctaaactaaactgcttgattttctcaatttctaaactcttgattgctttttcttttcgtcagcaaatcctcctttttattcgctattgcttgaaatgcgttttgccgtttatagtgctcctgttgcacacctactatcctttctcgtcttcacatcactttcgggttggcagataagaattgtgtcgcaaaggtatatatcccgtctttcttccttgcaaggtcaagcctatcggttcaaaccaaaatctccacactcggttttcaactgaggtcgtattttgtctgtgaagccttgcaggaagagccgggacaccttgcaaagcgacataattttaatcaaacccgaaagtagttgatgccaacagagggaaaagtaaaaaatcaaatcaaaagcgattatggcaaattatgcgaccaacatcttctacgcaagtacggagaacgagaaagaccttgataaggtggagaactttttggaagacacattttgcgactgttaccttgacaggtcggaagacagtatcgagggcgagttttcgtcaaaatgggactatcccgaaaaagagataaacaagatgatttctcttttggaggacaaagacaaaatctacattcgagtgctgacacacgaactatgtaacgagtatgtgaacttccaagtgttctctaatggagaatggtcataccgataaccttaaaaaactcactgactatgtattacgaggacgaacaagatacggacattatcgggtgcttatgcacattactgactccttacaaggggcatacagagggagaagtcgttggagactacggcaacgagatagtggtaaggctcaccaatggcaaggaggtggtggaataccgggatgaagtgctaatctatgactaatggaggattgctttatgatgacaccaatagcgacaaggtttgtggattgggatattcccgaactttcaaccctgcaagacagcaaggtctatcaattgagagtgcaactcaatgagggtacgccaatgagccgacaacagaaaaattggcttacgaacagcgtgaacagcaacacctatttcaaaagggctattccgctaatgggctaccgctttgacttctctgacgtactgaaacgctactttgtcaagcaatacggacatatagccgaatactatgctgtggacaagaccgctttacggacattcctttgcggtcggattgatgaaataattgagataacagattaaaagaaagattatgctgtacgattacagaaaagaaagcaaatcgcctatgcttctgactttggcgaatggcaagaccattgagggcgaatttattgatttgcggattgccaccgaaaccttgcccaagggtaaactgtggtatcatatccgacatacggacgatgattggagtgaaccagcctctctgaaaaacggctgtgtagtggtcaatttctgtggtacattcatttgtgaccctatcattgatttcccttgtggcgaggaactggagataacagaatggtcatacctgaactgaccgacatctggcagaatggcaatgtggggcaatgctccacattgttgtgtccacgccatttggaaatacatttccaatggcatcaacttttataattggagcttgcaaggcaagccgtttttcctcttatatattcatctttgacagtcaagtctccttttgtatatatggcatttcatatttcgcaatggcgatcgggctgctttgttcaacgagcaccggacttcttgccattgttttctttgccttgatttctccggttctgtcggtaaggtagaacgcgactattctctggcttccgcgatcttcgtgccattctgttcttcggctatcccttccatagcaaaatacctttggctgtgcagcgtcataacggattcagtattacggcatccacattgagaggacatactggattcctcgtctcatcactctgctcctttgggatttacagccgaagcgtacctgaaactttgtgtctgcggacggatgctgtcctttgtctgcgaaccttgctcacttgtttattcaccaatccatatcgttacagcttttggccgtgttattcctcatttttccgttgcaaagttagtatgcagccgggtacggctgaaagccttggtcaatggtgttgcttcacaaatcttcctttatctggccggaggttttgacggcttacgctgacaaaaataaagagtatttgattgctaaccttgtcgcaaccctgtaactgcactcacttatattggcagcgtaaaaataatttaattaacaacttaaagcattgtaacatgaaacagattgagaacaatttcgcagtatcaggattcgtaggtaaggacgcagaaatccgtcagttcgcaaatgcaagcgtggcacgcttctcattggcagtaagccgtcaggagaagagtggcgaggaaacaaaacgtgtgtccgctttcatcaacgtggaagcctggcgcaacaacgccaacaccgattcgcttgcccaaatcaccaagggtaccctgcttacagtggagggctacttcaaacccgaagaatggattgacaaggacggcgtgaaacacaaccgcatcgtcatggtcgctaacaagttctaccagacacccgacaaggaagaaactcctgcggagccggaaaagaaaacgaaaaaaggcaagaaataactcctgcctcgttccgacaaacaaagcggcttcggtcgcttttgtttttgctcgtatgtttacttgtcatacatctatgggttgcccattataagttttcacccatcccgtcaacggcttcttctatttttcttcgagagacttgctcggctgcgcaatgttgcacgttgctcctctttcgcaagacactctgccgaaatcgcccgatacaaaaagatttgccaaccgctccaagacttcgttttctcccggtaggcaaaacattttgttatttatcgggcttgcagaagaaactcgtttactgcccgccctttgcttgggttgatattttcgacaagagggagaattaaatactgatttttaagtccctcgctatgccagacatgaacgactgtcataggctgcattctgttggttgaatcttacctgtcccgctggtagtcgcttttgctccagcctccgaatatcactttcacgattttgatgaacacccacaatcccaatactgtaatgattacgtctcccatatcactgatttatttctgattactacttgtaaagatacgaaaaaaacgcgacataaacgaatgtatggtgttaaatatcaatatgatgaagcatttttttttgagaggatgtcatctgttcttggcctatgcaattccgaaaagttctatctcgaagatgagtgttgagccaccgggtatgccgggttgcgagaacttgccatatcccatttcggcagggatataaatctcccatttgtccccgatacacatctgttgcattgcgataatccaaccctcaatcagttcgttcaggcggaatgcaatcggagtgccaccccgactgctgtcaaatttctttccgtttatggtccacccggtatagtgggctgtgacgatactgcgtggtgcagggtgcttgccatcgttctttcccttactgatgaccttgtaatagatacctttcgggagtggctttactccctcttctttggctttcgcttccagccattccttattggcttgtatgtattcttttttgctcattttatttcggcttttttaatttgtatatgatatggggcatttctttacctcggtaaacaacaatatggctactacaagattccataccaagccgttttgccactcgaatggaagccttgttttccgggcggatactacaatatacagccggtaattccaagctgtcaaaagcataggctatgagagattcggcggcttctgtcgcgtaaccgttgtgccaatatgtgttgtcaaatatgtagccgatctcaacgacttcattcccgttcattgttgttttcataagtccggcctggcctatcagttgtccgctttctttctgtagaacggcaaaatatccgataccatctttggcatatcggacgagctgtctttctatccagtcttgtacatcatcttcgctgaagccatgctcccaagcgtacatcacttccggcttacccattattgtaagcaaagtatcaaaatcatcattggtaagtttgcggacgagcaatcgctcagtttctataatgtcggcttgtatgtaattacacttgctcatattcagtaaatcaatctaatgttctgcatgctgtttctaatatgtcaatcatctcagccccgtgttcatgacattgaaccttaatccatttgtcatttgaacttttttctataatatctcccataatgcgaagtttcaaacttcctttttgaaccattttgccatatgacttcatctttgactctggtgaaaggtttgaaaactttgaattgacacttcgagaaatgatacacagatttccaaatgtatctttgtcatcccatgagtcaaaagaaccgtcagatggattttgtggataccagtgttcaacagagttacggaattcgaattcaaaatcgctgtatttgcttttattattcttccataacaagtaatccagaaagttgaacacgatgtgaggagtcgttacaccaagtttgtagtcctttccatccaagaaattctccttggttgccagtgccgctatgtcttcagcctcgtttgttaatagggctacttcatcattctcaaacagccatagaacaagctcggttatccagtgcatgacttttggggatgtatacgatactcgaagcgcagactgaatcattaaacattctttattgcgtggagcatatgtcgtttcccattctttttcatacttcaactttgtatttgaataatatgctttctttttagatgcctgtccagatgtgtgcaattccttaagactccattcgccctctttgtcttcgccagtatattctctctttatgatgaaactatcaaaaagataacgtgtttgcaacagatgaataattatcattctggcaaaattttctttgttgttcttgataggttcattatctaatgttccatatttaatcacgttttcaaagtcagcaatcaatttcttgtcatcaagtaattcgcccaaatctttttccaatgacacatcgtagaaatccacaaaaaccctgagtgcatgaagcaagaagtacgggaattcaatgatgctttcaaagcgtatatgagtatcatcgtcaagtatgccatctacattgtcaactttgaatcttggcttaatgatttcgtttatggttgcattattctccgaatcctctgtaatttctaaacagtcactatattcactccattcattagcaggccagccattccactctccaccgaaaatgttttctctttctgttcgtgagaagtgcatttgaacatagcctgtcatatcgctacaagcattccatatccgtgaaaatagttcttgttcctttctattgttgagaaatctcatgagccgggctttaaggatatcatgctgttctaattgctctccacgggtgttcattatctcgaagtaacggtttaagtctgtatgttcaggcacttctatcttatagagaatcacatgttgcaaacgggaaacaaattcatccttgtttaatcctttgtcactcgtaaacttttgacggattgcttttataccattaaggatagactgatctatattttcctcataatcggcagaaggctttttgtctgctagtatttgttggatattagaaagggtatatttagatttagagcgacaatcaaaagagagagtctgtcctaattctccttccaatgctccttctgatacaaggtattgcaataaaagaaaaagtgttgtaagacgttgctgtccatcaacaacttcatacgttttaggtttatcttgtaccttggaaacaacaagtgaaccgatgtaatagttctcggatgaatcaatatcgttaatatcatcaattaattgcgctatctctttgtcttcccacgcataggctcgctgatagcgcggaattacatagtgagtatttgtatcgaatattgttacttcatccaatatttttaattcttctaccatattaattgtatccattaagttgacgaagttgtgcatataaattgttccaattttcactggctgctttgtcatcatttctcatgtcaagtctcattcctgagatttcagtatgtctacgcgcataagcaatcatggatattacgggttttacattgctgtatttgtcatcttctatacctatggcatatctattaatagtatcaaagcctaaatgctgcatatcaattctaatcatcatagcccaagtaaatagttttttcacggccatgacatcaaagttgtgaaaacggtcgtaatagcaaagcaaggcgcagaaaaagaggtttcgtgcatggttaagtccaactgatgacgatttgaaagatttatctaattcttctgctgaatccacatcttttccgtttgtaataatcagttcgatatcatgaaatgctggattcgttacaatttcttcttttatattatgcaacatcttcatatagtgatcaaccatttcaaaaaagtcacttcctgaaatgaatggctctgtgagtaggaaataaggcatggctttgttggctctgcgcgcgtaagtgtaaccatacttctcttcaatacctttatagatgtctatatcagcagaagtgaaattaccacactttcgacattttgcccaattccatatcgggaaaaggtacaagtcgaataactctctgatagcctttggatctttcgattcccatttcactacggcattctgcatctcatacttatcgtgaatctctctaagatgataagctttaagtaaatcatgcggatatagcgcacgaccacgtgtgttttgagaatcgaataattggaatgcttcatctattctatttactgtaatcacgacaacttctagaatgttttttagggcatcgttaaaaatggccttcactgtatcatcaacagaagaaaaccactctcggatagttgtatagttgtcatgtagattcttctgtgtaattttatttagaaacttgttctttagcagattacacgtaaaatcagaatctaaatgtaatttcaataaaaggaatgatagtatgcgctgctgtccgtcaacaatctcatactcattgttttcatttctatgaagaattactgtacctatacgatatttgaaattagcgtacttacggctttcttcaatacttttttgagtatcgagaatgagttctgttatgtttttgtccgtccatttatatggccgttgataatctggaatgattagattcttccctaataacttgtcaatagaccatatgtgtggtttgctattcattatttaaaaacgaatttgattgttacaatagttacacaataaactttattcttttgattcatcaagtgttatgtgaactttagaatgtgggcaaattccagctttaaatcccttaatcacatcttttaatgagatgctaaacgagtcagatatatagtgaatgtgcgatttgtttccatattctcctggttcattgcctaataacccccttctggtttgataaaagcaatgccaatgtttcccattgttaaggattcgtgctaaaacaaattgtgaaacagttattatttctttcatttgaccatctgttaatgatgtctctccatagtgttcaatggtattttcatcgcatagataaataaatgatggtaaatctgcacctatatatttttttggtgtatcttcaaatctgtaattgctgaatttgtaccctttatcattggcatataaaaagattgtagcgagttgttctggttttattgaaataccccttaatagagaaatttgttcttttttggatagttcttcttgaaatagcaatttaatattttcgggaatttcgagagaagtagctctagcaatttctttttcagctattttttttgatgccaacattattgctattggatctttgcatatcgtgtctaaattctgttcttttagaaccattgcttctattgccggatagattgattttgcatgaaaatcaattaaatattctctcacattaacgttttctacatcgtccatgacgttggcgataacatattttgagtcgttattgtaaattttactatgtcccataattagttttctttattctttcttttcccaagcggcccgctgaacttgcctcgattgagtgaaacaccgtatttattaagaatgcggaacaccgaactgcggctgttgaatccactcactttccagatgtcatcaatggaatgcccgttattgtacatcgccacgatagttttttcacgttccgccctgctgatgtttttctctttggtcggctggttgatattctgtttcagatggatgatgtgggctgaagccttgcgcagcatggcacattcctccggcaaagaaccgaacatctccagtacatcggaggctttggtttccggaaacaaatccccacggctgtcaatcttgtcgtgaatggagacaatccgaaccacctttacccggcagaactcgatgaatgtcgccagctcacgggagccacgcagggcattgctgaattttgagacaaccagctcgtccccacgctccagacttgccatcagttgtttccattgagggcgcagtttctcgtgtccgttctcttcctctatcacttgtacacagccgtatttctccatccacttcttgtcagtgtcgaagccgtcataaccggctgccttgaatatgtaacctacttttgccatagtgctgttcaatgctaaatgataccaagtgcaaagatacaaagtttaattcggttaaaatcatactcaataaaatatttttcaattattatactttgtattttcacttgttacgctcttgtttatttcgcggattatactcgtaagtatgaaaaagaaaatagattaaagttttattttagagtattatcatacaaacttttatacttaactttgccgccataaaccaataaaaatatcatgtataaaggcttgtttaaagtagaatcaatgcaaaaaccgaagagaggaaacttgaaatcatactcaaagaaatgtgcttcgtatgccaaatcttttgccgtatgttttgccattgtcacattggcatcatgcggagaaaagaccggcaacagtatgtttcagaccgttaaaaatgctgccgatgcttacaggtcatacctgtccgaggtgcgaaaggaagcaaacctgccaacagaccgtctgattgaaaaagtcaacgactggcagtcgcttcgagattcggtatctgcctgtgtcgccaaagacacggcaaaccgtattcacgccaattacgaaagcgaaattcgtggattgcacgattcgttgcgcattgaatttacccgtctggctctggagaagccgagaacttttgcggatgtgttgctcctcagagagcagacttcccaataccggcaagacacggagctgatgcagtcggcagcggaagcggagccgtttttcaaaccattggattccgtcccgacatataaaggcagtgccaatgctgtcgttgaaaaataccgaatgttcctttccaagaccttgaaatccggaataagcggcaagagtgaaatgcttgctttcataaaggaagaggacaggctgttccgttcgttccttgaccatttgactgaacttgccgatgccgacctttctgtcattacgtgcgacacggagaaatgctgcctgtcgatattccagtctgcggagaatggcaggctctcttaccgggatgccttggtatatacagccaggcgaaccaaccggagaatcatactcaacgctttggcttgccgtgatgacatcaaccaagacaatgtaaagaccgaagcgcaggcaagggcttacgtttggatgttgttgcagccgtatgttgccttggatggtttcagcgtggctatcctgtccgatatggaaaggacaacacttcatgcagtcgctgaccggacacctcagatgatagccaaactcaacaagactgccggaacggacaacgaccaatggcgggtattgcccggagtactgatcaagataatgctcacatccatttgacgaaccagaaacaaataaatacaacagttatgctacaacttttttacgatgactttctctcctttgtgccgctccagcttccgcagttgctggatgtaaccacaatggaacagccgcggttctatgacgattacgtcctcctttcgtttccgcttgccgacccatacgatctggaagaagtaatggacatcttcgaggacgacatggagctgataaccctttatcatcatattccttcaagcgcaacgacattcggcagcagcacctgtgcctattccaatccggctttcggacagatgttcaagatgaacgcgagagtttctgataccggcaaggttgaccgcattgacgtgaccatctatgaatccctggagttcatgtgttctgacatctgccttgacttgaaacttcacgaaaagaccggtcatttcaagtaccgcaagaccaaggaggagttgcttgccgaatttatatgagacggacgatatacctgcaaatgctatacattatcaatatgtacaggagttggatagtcgtggatgacggatatggatacaggcaaagtgtcgtgttcagacggggcaggccggtttcctgcgtgtgccgtatgctccggctccgttccacttataagcacaatggctatgagcgtggcacgaaatggagcatatccgaatacgagctggacaaggcattggcaaggtatcgtcaaaagaatcacgagttaaaggcacggcttaaaaaaggagcgtcatatcttgaagccaaggatgtggaagccattatagagattgccacctatgggctggtcaaactggaactgaccgaactgccattattcaaacaatactgattacacaaaggattacgattatgatttggattatcatcgaaatgtcatttccggcattgctcattatactgcccatgtcattgtacaggagcaaccggctttttatggcaaagttttaccttaggatggcgggtagtgagagtgcaaggaaactctatgtgcagtgtatgcttatcttcctcctgctatatcactatgtctatgccggcagacacttcggagagtggggagttctgatatccaccataccttgtgccgttctgttctcgttcagacgtgccgacaggtggatgcacagactccacgaggataaaaaaaggttcgttatggcagccttcatcacattggtcatctgcgctgtaccacatctgcacaccacggcgttcacactcgcctttcttcttttggctgccatgttctatccctcttgccgtgtgttagccgaatggaaggatgacgacacgcgcaagcatttgaaagaaaatccaaaaacaatgtccgaacattactgctgacatcatcacgcgaacctgccacgaataagtggatagtggcaggttaatagaatccacatatagtcaaataaaaatcaaatgaaatgatgaaagacaagaatagagccgccaatcaggtattggcagatatgatgtttttcgactacctcaaagagaaagtcggtgaacggaagacaaagaccggtgcctactacgacctgttggagaaagcaacggcaggttttatcgctccctttttgaagaaccacgagtatgtgttgcaggctgaccagtgtcatgtgaccatttcagaccttgcggtggaatggcactggcacagggctaccgtcagggcgttccttgacaaactggaggagatgggatatattcgtcggacaaggttcgcaaagagtgtggtcattaccgtgacttttgcgccattctccagtggcgaaactcctgcctcttataccggtcatacaggggccggacttgccgatgatttggacaaggctttgtccgaatggataaatggcagtctgtctgacgaagatatgggagagatttgtggacagtatcatgaagccggactgaaacggcttgccgatgaatccggcaaagatcattcgggcgacaagccggcaataaaggcaggtgcagaaacggagttagcccaagagattgtcgaacgtgtagccgtagccggactgaaacgcgccatacgaaattcgcgcttcgatgatccgaccgatttcttggagttttttcacggggaactgggaggtgactggacttcacttttggaggcatccaagataatcgccaagatgattctggacgctggaaacgacggcgcgcccaatagttcgagcgaaacggatatgcttgccacgctccgacagccgttcagggcgttgtgggcaaagtaccaggagcgtgattccacccttttatagactccacaaccgatgttgtaagtcaaaaactattgtataaccacggatgaaccgtgatgccctacatttgtaggcttgccattttaagcgtgcagcggtgcttgcacgttgaccaaacagagggaagtatgggtaactcaataccccacacgactacggtcggtgggagtggttgccggacaagcagcaagctggggcaaatcggttgtccgataaaaacggatgatatggctgaaaaatcatggcaggtgatgcacatgaacgtgatgaaaggcataaccaccgcgcaaagcaacgaacaccagcgtaactggacggaaagcggctggaaacacgccatagacaagggaacttatgaccgccaaagggaacggttgaatttcgagattgtaaagggcggtaaggtgcgacctataaacaaggacaagtctattcctgaacgcatggctgaaaaccttgccgggcgtgggataaaagatcccaattcggatttggcagaaccgaaatttcgcacggtcgtggattttatactgggcggatcgaagtttcaaatgcggcagcttgcttttggagaccaggctgttgtgtatggttccggtaacaataccgccaatgcttcgcttcaacgaaagccggaaatagaagaatgggcaaaggatatgtaccgattcatgagtgaaagattcggtgaggagaatattgtcgggtgttatgtacatcttgatgaaacgaccccgcatatgcaccttaccttattgccaatccaagacggtaagtttgcgttcaaaaagatgtttgcaggaaaggacaaatatgagttttctgcaagaatgaaaatgttacacgatgaactctcgcaagtgaacgaaaaatggcaactggaacggggacgtaatgtttccgaaactggggcaagacatcgaagcacggaggaataccgccgatacctttcggaagaatgtaccaatatagaggaacaggttgtccaacacaaaaaagcattggcagaccttaaagtggaaataagtctggcagagcgcagggtgaaaggcttgacctctatggtggataacctccgaaaagcgaaagcggaaaaggaatcccaactatcggcattggaacgcacccttcaatcccatcagggagatacggctaccattatagccgagagggaacggttggaaaaagaactggcttctatccaaacgaaattggaagacaagcaggataagctacggacggctgaccaacagcttgaagcccttaaaagggacatggatgccattggcgagcgcacggaggaactgaaaggcgaagcctataaatacagtcgtgaaatccattccaacgtggatgtactgctcaaagatgtgatgctggaaacattggttggagagcattcggcaagagtggctgaaatgggagctgcggagcaatccgtctttgacggttctttgttgcagagcctgaccgagcaaggggcggaagtgatgcactgcgccacgctcctcttccttggtatggtcaacgatgccactacatttgccgaaacgcatggcggtggaggaagtaaaagcaaccttaaatggggaaaggatgatgacgaggataaccgtgcgtgggcaaggcgttgcatgatgatggcaagcagaatgatgcgaccggcttccggcaagaagcaaaagaggtaatcggcagaatatgtttttctgcaatggataacaaaacaaaataatgcgttgaatatgacaaagaaaatatttttaattctggcagtggcaggtatgggctgttcactgcacatgaaagcggctgtaccacctgtgacaaaggacactgtacagctggagtcgtacacggatatcgaacagatgctccggcctttggatccgacttaccataagggtgtattcgtgacatcgccttggaacggcaactggtttgtcagtcttcaaggtggtgcaagtgcgttcattggcaaacctgttggttgtgccgacttatttgacaggataaagcctactattttcgcatcgcttggcaagtggttcactccgcagatcggagcaagaatcggttatggaggttggcagttcaaagattgcgaactggtcacaaatgactaccatcactttcatgctgacttgatgtggaatgtgcttggatatcggtatggcaaggttgagaatcctcgttggggaatcattccatacataggatttggactgatgcacaatccgcagaacggacataatccgtttgccatttcatacggaatacagggacaataccgtatctgtaaacggctgtctgcattgttggaaattggcaatgtttccacattccaggactttgatggctatggcaaatccaatcgtttcggagataatatgctctccgtgtcagccggcttgtcgtttacgattggaaagaccggctggaaacgtgccgttgatgcgagtccttacatccggcagaacgagtggctgattggttacgcttcacagctatcggagagtaatcgcagatacaccgggcaacatgacagggcgatgagaacgatcaacgaattgaagaagattctggaaattgagggcttgcttgataaatatagcaagatgtttgatgaccgggagagtttgggcaatgtctatccgagaaacgattacagcggactgaactcgctccgagcaagattgaaaaacaggcattgggatggtaagtctccattgtccaatgacagtttgttcagtaagtctgaatttgtcaatgccatacccaataatgacggtagcgttgtaaacggcttctatgtcacaggtgccgattccctgctgtctccagatatgaataatgacagcatttccatttatagccattcggattatctctcctttataggttccggcaacgagtgcatcggttcacctgtctatttcttctttgaactcggcacggctcaactgactgataaatcccagttggtcaatctggatgaactggcgcgtgtgacaaagaaatacggattatccgtgactgttgcaggtgcggctgacgctgccaccggaactgccgatataaacaataagttgagcgcatcgagagccgattatattgccacggagttgcgcaggcgcggagtgactgttgaaaatataacaaaggtctgtcaaggaggtatttccaattatgtacccactgaagctaacagacataccaaagtcatgctatatatgaaataggaaagtgtaagattctttttgttcaaattgattagttaaatgtcaattcttttgaaaggagagcctgtccgtgatggatcggctcttctgcattataaaaatctcgttataataacttttgtatttcgctccaatagaagaacgcttctgcattcgtcttctttaatttattcaatttggttgagagtggagagtgtatcgttacgttgaccaatagatttgcttcggatggattatagtgctttatctcatttatgccattactgataagtttggcaagataagctgcctttgaagcatttgtaatagcactttccaaagtatagacttcactatgaataaagccacgcacttttttaattccatcttgaatcaggtcaaattcctcctgattgtcctgcccgcgcattactatacatttggctgtatcataaatgtcatccaaaactttttgaattgcatcaggattctcacctctgtattgaagttcaaccatcgcaaacttattgaatgtttccgctgtaacagataagtcaccaactatgtcgaaaagcgatgcaacgtcaaataactgtttacagatttccattgaacaattcttttctcctttgaaaaatgggattccggtcgtgtgaggagcaaacgcggttaatttatcaccgagcagatcttctttacttggcaattttaccattacgggatctccttctgtctttaacaaacgacttttaatgggaagttccaccacatttgcataatgaatttcctcgaataatacatccaacagaatcttgtcctgacgtcctcctgccggatatgccacctggtaaaagaatttggcatgttgttttggtatatcggtacgagagatacgttccaccaatttaacctctccaaaaccatattcttcggaatacttttccagataatcttcaatccttgttcctggaggacaaattatatcaatgtcgattgaaagtcgtttgccggtatcaagatgaagcattaaggaagatcctcccttgaataaaaagggacaaccggaccgggctaatgcttccaacaacgagaatgcacggattgttttttcaacgagggctatatcttttatcttgttgtctttggctacttgttctatccaagataatgtcctgctatcgggatgtatcatatattgattgtattgataatttgttcgactttttgttttctgttacggcgtgccgcatatctcaacagccgtggcattttgatttcatagtccgagaaggcgtttgaatatatagtatataattcattaccctgaagatgttgtagttccttgtcggatatggcatcaacaagcattttctccaatgtaggaacgggacagccatcaataatatctattggagcctctttgacaagaggacgaacaataatcatatcacgatttgtaatatatcgatccgcatcttcttggttcggattcaaaaaaacagggattgcagattccatgttttgtaatgacatgaaaacggattccattgccaccctttcaacatctaccaatgtagttcttaccgcaggtatatgtaacatcatagaagcgaatatagatggttgccatatacaataatctatgaaagggaatttttcttttatatgtctgttgagtgaaagcataaattcgcttggctcatacaaaaaatcatatttcaaatcttcatttaatttgtatttcccgtatgaaactctgatgattttgttctctgcaagcatcctattcaaaagcacaacaagagaaccttctgatatgtttttcataccagagcgcaccgcattcagcaggtcttttcgtgtgaattgcccgtcctgttttctggcaatatctattatctgatttacggcagtcattattgttcttcaattatgttgcgaagttataacaaatttggcaaatatcaatgcgtcttgccgattttgttatgcttttaataagaaaaaagcatgaactatataacaacttcgtcaaatatcgaaagaatttgccggagttgttatgcttttcctgttttacaattcctactatctatctgccaattatagcagttttacttgtcacatataatgaacacctccggctcatcttgctggctctattttcctttgcaaaggtactgcggtgagggaatgccaagtaccgctatgcaggtcgttccgctaatggcttggtggacttgacgacaactttcctcaatttccaccaagtgttaattgggtatttcatcaactcctcagccatttacttgtcttatccttctgtttccacagtctcttggttgcacgtaaaattcagattccgacaagaaagccgataaaagcttcaaaataagggagaagaaaaaatcaaaataaaaaagattatggtaaatatggaaacaaattcagatgagagaaagataatagacagagttttacatcgtgatatggtattcaggtaccaattattaggtcgtttacaagctgattgcgaatactaccttaattacggcaatcggaatatcaaacgcttgtgggcaggcaatgtaaatctgcaaattaaactgatggctgaactttataatagtttcaaggaagacgaaaaacctcaatggcttacaatggatgaaattattgcatacggaaaagcaatggcagaggaagaataaaattgatgtattaacggactgagctggtatttggcttcagtccgttatcatcgtttccttctttgatggcaatgccttttatagtccgtttaagtataacctaaatggaacctaatatccttttttatccggaagataattgtcgttacctttttaatagtgtgcctttgacttttatatttattgagaattatgaactttccccggctcatcttgtcagctctattttcctctgcaaaggtactgcggcgagggaacgccaagtaccgttccaccgatcggctccactaatgccttatggatttgacgacagctttccgcaatttccggcaggcgtaaattgggtatttcatcaactcctcagccatttacttgtcttatccctctgtttccacagtctcttggttgcacgtaaaattcagatcccgacaagaaagccgataaagacttcaaaataagggaaaagaaaaagacaaaagttcaacgattaaaacagactgattatgcacagcaagatttttcaaatcacggaaacaagagttgacagggacaactacttgaacgaggacacccttgaacaaggggacggacactattacgactattgttcggagatagacgaggaagaacgcaaattccatattgccaatctgatagaaaaggcattgccaaaagggatgttcactcttgtggcagaaaacacaatccgatacaatggcggtgcggacaagtggaaaaaggaatttgttacagccatccaagaaaaggcacaagccgttaccgttgaaaactgcatgatgtggattggagcggtgtaccagcttgaaaaatttctcaaaaatccacttgacctcggttatcagttctatatggacgagtatggcgttaatggctatgccgaacaatcgtactcgtttttacagacggtcagccagtttgagccgggaaaactactttacatcggtggagttattgactatcatttctaaacactatgaggacaagacgaatgacaaaggaacaaggacagcggtgcaatatcagccgatttcccaatttccaccacacaggcagtatcaaaggaatgaaacggatgtactacggaaaccaagcacttttggtaaggtgcggagcgtacatatacaatgtttcaagtgaaccaagtatctattatcaagcaaaataacagacattatgaaaggaacagaacatttcaagcaggcaattaaggcatatctggacgaaagagccaagaccgatgaactctttgcagtgtcgtatgccaaagagaacaagaatttggacgattgcgtgacattcatactcaaccaggcaatggcaatctgtaaagagggcggttgcggtatgaccgatgacgaggtttattcgcttggagtacattactatgatgaagatgatatagaagtgggtaaggcggtcaactgcggagtgatagtcaaccatagagtagaactatctcccgaagaacaagccgaagcgagggagaatgcactcaaagcctaccaaaacgaggaactgcgtaaaatccaacagcgaaacagcaaaccgaaaccgaccccgaaagcggtcagacaagaacccgaacaaccaacattatttgatttaggactatgagagcgaaaacgagattacagcataaggtagtaaccgccaacggacggttactgccacagacaaagaagcaggagttatgggcatttcgtcaatgtatcagccattacgcataccgcacaaaaaacggaggaacgacctgtatggattgcggttatcaatggaacgagagtaacaaaaaggtgtgccgttgcccacattgcggtgcaagactggagatactggacaccaagtgcaggacattcaaggacaaagcgtattattccacgcttgccacacaggacggtttacaggtacagcgtgtatttcttatgaacgcaaacttccgtaaaggcaagaaagcggagtattattctatggagattgcacgctattgggtggacgataacggcaagacggagataacggcattgaaacgcacactcggacattatgcggacacttttgttttggacggctgtctggagttacggagagacaactatgtgtatagacggattgccgattgcaaggtctatccatattattctgccactccaaagttaagacgcaacggattgcaaggctcattggctgacatcgaaccgacacggcttatcgaagccttgttgacagacagcagagccgaaacgatgttcaaggcaggcaggaaaaccgatttgaactacttcctgcaacattcaatgtactttgatttgtattggaacacttacaagatagttttacgcaatggctatcatatagcagatatttctctttggacagattacatccgcttacttgaaaggtgtggcaaggatattcacaatgcccactatgtctgtccattagacttgaaagctgaacacgaccgctatcaggaacgggcaaggattattcaagaacgggaggagcgtgagaaacaaaggaaaaaggcaaaggagaacgaggagcgttttaaagaattgaaaagcaaattcttcggactgtcattcacggacggactgattgtagtcagcgtgttggaaagcgtggatgattattacaaggaggggaacgccctgcatcattgtgtcggacaatgcgaatattatctcaaaccgcagtcgttggtattttcagtccgaattgaaaaccagcgtattgaaaccattgaattgagccttgaaacattcaaggtattgcagtcaagagggctttgcaataaggctacggaataccacgaccgaattattcggcttgttcagaagaacgcccggcaaatccgtaagcgaatgaccgcataatctgttctgttcttttcgtcagccacttgttacgacacacattgtagcaggtggctttatgcgtggctacggtaacttgctgtttaccgtagtgatttctgttatacaagacttaaatgctaactgttgtgcatcagcttgaagaacgaactccgaactagaaaatctaactttaacaagataggattaggttatgacggatgaaatttttcggggacaacttccagcatttccaaaaaacagtttttccattgacttggcgacaaacatacaatttgtgcattaaggtttattccgaacttttccgaaattgacctgacctgactttttctgaaaattgactttagggctgttctaacagataaatcaggtttctgtaaaagacaggaaataaacgctaaatatttgactttaagttcaaaatcaatagacgactgttttcttttaatttttaacagagctgacttgacagttggcggtggcaaaaaacttccgggacttatctcgtacaggaactccaaatcataaaaagtatgataaaacaccgtatatggattataaaccttacttgaaaccaacttttttgcaggctctgactgaaggacaatggaacctcccaaaaaaagttcgacattatcaaacatcaaaatcctgaaaatatcggaagtaatgccataaggaatatttgacactaccttaaaaggtaacagcggaactgtaaattttctaaaatcacacccaacaacctgaacgttttgggcattattaaacctcttacacaaatgcttgtataagaccaagtcgttttcaatggcaacaactttgttcacatttttcagcaggtggacagtaataaaacctttgcccgcaccaatatccaaaactgtatcttgttgagttatatttgcttgttttattgcatcttttattagcactttgtcaatagtaaagtgctgatccgtgaaacgaacgggcaatttctttttgtcattaattaacatcagttcggtgaaattaagttgttgattattagtaaaatagcaatatattttgtaaatttgaaatcactacaaatcaacttcacaaaatacattgctatgatctcaagagacaaaattactgaaattttctgtatggccgatgacttttgcaaactttatgaccgattcatcaaggcaaacggtcttgcacctaagcgagacaagtccaaacgcaagtatcatcgcgactcgagaatgtcctctgcggagatcataaccataatgattttgttccacctgagcggatataaatgtttcaagcatttctatatcaatgaagttaaagaacatatgactgacatgtttccaaagacagtggcatacaatcgatttactgaacttgaaaggacagttgtaatcccgttcattctctttgtgaagagatgctgtatggggaaatgcaccgggatcagctttgtcgacagcacattgcttcgcgtatgcaggaaccaacgtattcatatgcacaaggtctttaaaggtatagctcaacgggggctgtgttcgatgggatggttctatggcttcaaacttcatctgatatgcaatgagatgggggaactgttaagctttaaagaacaagactttcgttgaacagttgtttggaaagttggccggcgacaaagggtacatatccaaggacatcttctcaaagttgtttgtcgatggtattcagcttattacaaaactgagaaataatatgaagggacagataatgacgcttagtgacaagatacttctccgtaaaagggccatcatcgagaccatcaatgacgaacttaagaacatagcccagattgaacattcgcgtcaccgatccgttaccggattcactgtcaaccttatggccgggcttgcggcatactcattcttcccaaagaagccgatgattgcagtagagagggttgaatcagaagaaaacggacttattcagctgtcactcttttagttataattcatcgaactcacgttaattacttcttacaggtgaatacttgaattcaaatcgtggagaagtgaataggcagtattacccgacagagcaactacgacaaagcaatgctatcaaaaaaaagacagcacacacaaagcatagactgattgtcttgacctaaaagattgattggaatttattcaggactgcctatcacttagatagaagtccaaggtctgctgaaatacataattcaaaaattgaaattgcttgactgcaaagatattaactttatctgataaattagtaaaaaaagaaagccgaatgcacaacaaggtgtataagcaatagcggggaaagtgccaaactcaaagtttcttccttttagctatctttgtgcctaaccgaacagtaagtgcataaaatccgctactgctcatacacttgaccgttataatgtactgcatatatatccttttgtataatgtcggcaacaaataaaaactattgccgaatttatatcctaaaacctttataggataatctcccattatagtcatcggaggattctccttagagccggccatcacgccacacggcattgttttatcgtgcaaaggtactatggaggtagaatgccaagtaccgcctgcgctaacaattcagtggacttaacgacagctttccacgaatgtgccattagtggtatttcattaactccctgtttatttacttgtcttatctcccttaccccatagtctttaacgcacataaaacatatcccggtggcgaagtttaacagcttcaagcaaagggaaaagaaaaaatgttcaacatcaaaattcattagaaatggagtacaacaatcaattatcggagaatgacaaacgatttgcggacgagttctcaaactatgtgaacggcaaaatggcttcaccccgaaaggtgggcaaggcattggcagacgaccaccgctatttggtaaacgagaaagccaaactgatgttctactttatggagcagttggcggagaactggcacaagggaagatatgaccagcgtaacgaatgggcgtgccgtctggcagcggaagccatagaccatttggcagagaacgacctctatcatttgcccgaagagtattacgaaaaccataaacaataatgaatatgcaagcacttcaaatcgccatcccaagatggaacataacagagttgaacggttatgagccgataaccaccttttggcaggatttctccattgccgacaagttcgggaacaatgccatagccgacacatacaggcgagccaagtccgaatggaaagacaactacaagtattggacggaactttgccttgtcctcaatcacaagatatggcagtggcacgagcgagacaatcaaagagccattctctatgacaaactgtggagggaagcggatgcaatgaccgctgaatggtcggacgaggaacaggaatattattttgagataacggattaaatcaaccagtggggagattggagaggtctccccacaaaaacaaagagtatgactacccaagaacagatacggaaagtaacggacattgcccaagaaaaaggctggagcataagcgttgaagacgaaaacaagacaagcatacaatttgagtttcaacgctataccaaatacgggcaggacttcaatttcaatgccgatatgcaggatgaagacatcgacacgcttattgccggtatgaagcgatattacgaggactttgacccggattatgaagcctatttatggattggcgatgacgggcacggcaagaatggcgcaccttatcacattaaggatattgtagcggatatggaagaagtcgaagaaaagatatacgagttgctacaagcacttgaagttgaatttatctaatggctacaactatgactttatcggacaaatcatattacagaagactttgcaggaacatccttgcagaccgctttaactggcgaaaatactgcacaccgagcctttattttggcagggaaatttgtgtaacaccgcttcattgttcctacggacaaatcggctacaccatcaatttcccctataccaatgcaccggaagtggagtatgattgggaaatgaacaaacttacgattgatgatgaaaattggaaattggtatgttagacgaaatcagacaaaacggcaaaacagtgttgtcaggagaggatgggttttcaatacctatgtttttcaacaacttgtgcggcaaaaaaatttcaggcgagaagtaccgggattatatcagatacatagccttcggagaaatgggtttcaagcccggagaaatcatgctttaccgcaatggtacactggtaaggactggtaaaataaatattgaaaaatagatacggatatgggaacgacaactattcatcctgcggagagctatcttcgcaacgaaaccaatccttcgtctctatatgtgaggattgcaggaaaacgcagacgcttgttcattaatcgggacaggggtgttattggcattatcgcgcccggcaaaaggacaaaagattatgcattcacagattggtcaagcatcgagcagatatactatccctcgcaagaacaggaggcgaatacggacaggaaactcattctgaaatatcagaaacttgcccggcttgccacacatacaaacgcctggcttcgtgacatcgcaaatgcggatttggataaatccctttacgagaaccatatcacgacaggaacacgcattgacggcaaatgtatcgggcttgccactatcgaaaaatattgtggaacggcatctatgcagcgtttcagagaggcaatgaagaacaaagagagtttttccacttgtcgctttgatttttgcggttatgacggaacgctttggtgtgagccacgggacaatggcgatatgtcggcaggcttcagcaaagaataccggaattgtggcaacggctattactatctgcttatcaacgatgaatacgtgataggctatgatattgactgactatatagctacaacaatccaaccgcaaagaaagagactaatttgatttggaaaagcgggtaatatagtcaccccacacctccaatttgacaatcagcggatgcggcatagtgatagtcttgccatagaaaatggcagctaccaccttgccaccgcaccgttctatctcctccttgtagtcggtcatactttgcccggtagtcagtacatcgtcaacaataataacatctttcccttttatatctcctgtgattcggtaattccgttcaagtattcgattctcataacctttggcttcatgcaaactttcacgtggctcgaacacatcaacatcatatagtcctgatgtcagattcggacaatgggtacagacataccagttcaaacgcttgaatcgctggatatatttgaactcatcgctacaaggcatgaacatgatatgaaaatggtggtcatccatttgtaaggcgttcatgcaagatttgaaaaactcaatgccgtgtatttttccctccttaaactcatagatggaatggcagaacgcctgctgatcatcgttgagaaacggtttgtaccgggatggataatattgcccatagaatactactcttgtaccgtgcaatttgaatggtttgagtggtggctgttctttgaataaatccggatgtaaacaatagaacatacgacaagcatcccgatgaccggctcttaccgccaaacggcataaacggtcacgttcatcctccttctcggtcttttgcgcagctaaaaacgccgtttctccggctttccgccgccaatatccaacgatataccataggacactgataacaccgagcaggattacaaataccagcctttcgtgcatcttgaccgtgaattatgcgcggaatagccttcgtgctgtttgcaaaaaatcatacttccaacagttcactcgtctttgcccaataatagaaggcttccggtagattgcttttcaacttgttcagtttgttggtcagcgaaggtcgaataaccaaatccttgatgtcaaccggattgtttgaatagcgttccacttctgtgactcccttttcaatcagcgtggctaaataagccgcccgtgccgcatcaataatagcattgtctatcagataccgttgtttgtacataaatgactttacacggatgattccgtcttgtatcaagttgaaatcaccttctccgaatttaccccgtgtggagatacagagtgccgtttgacggatgtcattgaagacctgtccgatatccgttcccaaagaccggtacgagagttcgactaccgcaatcttgcggaaagcctctgcggtaatctgcaatcctgaaacattttcaaacaaccgccccacgtcataaagttgcttggctatctccatcgaacaagatctgccgttcttgtaataaggtattccggtagtgttgggagcgaaagctgtcagtttatcccctaaaatatcttctgcggacggaacagtcaccattaatggttctccctccagccgtatgaacgggcaatcaatggctatttgccgggtttggaaataatgaatgtcctcgtacagtacatccagcaggatataggattgggcgtccgtgtcgttccggtaagctatctgatagaaaaacttggaatggcttttaggtatgtccgcatcgtccctttgcttgcgctctacgagttccagattgataaagccaaaatcggcaaacgatttcagatagtcctctatattggttccgggaggacagatgacatcaatgtcgattgacagacgatgggcagatttcccaaggatgagcataagtgctgtgccacccttgaagacgagaggacacccggctttaaccaacatttcaagcagggataaggcacggattactttctctatgaggttcttgtcattgtagtgcagttcggatgcaacctgttcaatccattctgtcgtaaaacactctttctttatcattgtatgtttaagttttctaaaatcgacgataattctttcttcactttacgcctgtcggcatacctgaaaagcctgttcctgttgattgtgtacaggttaaaggcgttttctatgatacggtcactctcactgccttgcaggtagaaaaagtccgtatctctcaatatatccactaacagtttttccaacgtgggcataggcacgccggatacttcttgcaagggagcttccgaaacaaggtttttcacgaaaatgacacggctgtccatatccacatatcggtatatcatatttttgtccggtcgtaggtaaacattgtggttcttgtctttcagaaaattgaaaacggtttctgccgagtccctgtccgtttccacgtagatgatgcggttggatgaaaggtgatgttgcaaaggggctatgatgtccccttgataaacacagaatttcgcaaacggaaaatccgattgcaacaaaccgtaaacctccttcacttcctctatcggttggggtgaaaagacctgtttcatcactttggcatacgttccccgcccagttctgaccagtacattttcattcacgagcttgaacagataccaggacaaagaagactttttgatgcctgtcttctcttgtagataagcaaacaaatctcctaaactaaagtcatgatgaacttcagcatagtcaagtatgaatgttgtcgtctcgttgctcatgtgattattattcctttcttcgactgcaaaggtaacaaattttcggcactaattcagaatagtgccgatattttgcgactaattaaggtgaaaaatctctcttttttgtgtaagtaggacttatcagtgggactaaaccaattcagccgcagagagggcgactctctacggctgaacagaacagatagcagactttatactcagcggtgcatcccgccactgtattccacctcctctttttgatattgctccatttcattcagcttttcattgacggattggagattggaatcgagcgaattgtcgtggtcgtatggaaaactgtgactgacggcaatcccggcattggtcgccgtgccgacatcaagggtgtcggcatccctgttatacccgatatggagaatatctccgtttggcatttcaaggacaggagtacgctgccttgtcatcgcagagaactgctcggccgccatgtctttggcaacctcttttatgtcactgcttgccagccggacaccataccgtgtgatatggtcacggatttcctgctcagagtatttcagcatcacctcgtaagttcctcccacgctgttgttatagatcacggcaaaatccttgtcttctatcagcagatcatcacccttgttctggcgaggagagacaaaggtatattgctcgttgattccattgccgtcataatactccttggcaagccggagtaatccctcataatcgcctttctcccgaagcgcatccagtcgtgaggtgtcatcggtggattgcagataggctacggaagagtagaacacctttccttcgggtacggactgtttgatctcattccgctgtccgttatcatgctgcaccttgcttttctgttccagttcctgcactattttatccacattctgcgtaacgagcgaggtagccctttttacatccagaagtgtggtcttgataaactggggcgattccttcaagtggtccagccaggatttcagataagcgcagctctcttctttcaatgccttgctcatgccgtaacgctgtgccaccaatgcgctgcctaattctgccaccagttcctcacgtgcgtattcgtccgaaccgaaaccggacggtttgatacggtcgagttgcccctcgatgcccgtactgtgggtcatctcatgccaaagagtaccataataggattcgccgtccttgaactgggatttttcgggaaccacaatctcgttcttggaaatggaaaagtatgccttgtcctggtgcatcggctttatcgggcaaatccagcggttatcacggatcatcacatccatcggttcaaaagacatcttctcgctttcatccaactttacggcatccccattcgccaacttgctccaaagttccggacgggcttcctgaagattggtttgggctacattgaatacccggaagacctgcatcttcggatatacattgtacatcttcttctcttcatcggagagtttcttaaaatcgtcatacttgatcttctccttggtctccttgtggatgcaggtaaaggtagtgagcatcacggggaaggatttttcgcccttgttcactgacaccctcggcagttccacgccctcctttgcctgcttttcggacggtttgttcatccgttgcacgcagtcaaaggtgcagaaacgcggtatcttgtagccctcgttctcgcaatgaagaagcaacatcagcgcgttcatcccattatactcacgtccggacagattcttcggccaccccaggctaccctcggtaatccacggtttcgtccagtccttgctgatggtctcgatacgctcgatcatcatttccgcaaagaggtcaagagccttgtcctccgcggacgggccgtcattgctgtttttcctgtaaccggccatggctgtcagttgttagggttatacggctgtttcacatattccgacatttccgataccttgcaggtaatgttcagcttgtcgttatagacggacagttccagttcacctttggcctcgatgccggtctgcggttgcagccactcctcacgtttacggtcaaagcctaagaagcgtacccacaggtactcgaagccgtcattgaccttttccgcagaaaatgcggagaactgcaagaaattcttgcctttcttgtctgtcttctcttcgatgttcttgcctgtctttccacggaagagcatttcgcccttgatggaatcctcgtttgaagccacggtaaggttaaccgatgaagccgacagattgaaatagaggttgtctccacgcttcttgaaagtcaacacaccggaaatttccactctcttgcctacggtatagtcagcccgattgtactcctctccatccttggcgacagagatttccactgttttgtcgataccgtttcttgctggaatcacgcaatttacggcaaatgccgtgaaagccttgttctcattgttggtgcgcactacagccgccttgctgatggttccgcacactgttacgttacacttaatcatattgcttgtagttttattttaaccaagaccatttgaccggaatatcctattaaatgtgaactacccgcatatacgttccgtctttaatcgggcgcacggattttaatccagactatccctgacgcaatgacaacctgcacacccacaatcacgagtgtcaccaccagaccgaacagccggtagcatacaagggtatgcagtcctgcaagggacagtccgacaaacaacaatcctatttccatcatcacgcttttcattatcttctgatttgctcgttctggccctgttgctctgacattccctgctcgaagttctgggatgcctgttgtgacaacacaatggcattgaccattcctgccactcgcatacgcttgctttcctccgtaagtcccggattgttcaaggtggcggacagccggctcaattcaacggtactgagttcccgtgagacttgcacgataccgttgtctgcctgcaatacggctttgttgttctctccgatgacaagggcacaacttttcatgtggggcaacaatgaagtcagttccaccttccggctacctgccatttcagaaatggcttctttctgttcctcttcgttcttgttgtcaatgactaccgccagcatcatcagcgaggaaaaggctttgaccaccatatccataatcgggtcattcgttcctgaaagtccgacaccgctgtcttccgaggataacagtttcttcatccactcttcaggactttgtgattttgtttcctggggagtggcagtaacctccgttttgtatttagccaacaggtcgttgccattatgcaaggcttgcaacttgatgtttcccttttgggcaatgtctgccagatagattgcgggatcaatgtctcgtttttgtccgtcagcggtaatctgtgccactccgaaatgcaggtgttcgccggtagtccgtgtcccggtattccctgaaacaccgagtctctgtccggcttgcaccatatcacccaccttgacatcaacagaggacaggtgcatataagtgttctgtatcttgcttccgtcagccctctcgtattcaatggttacggacttgcctccggcggttttggcattttggtttactgccaccactttgccgttattctcggtagccaacaccgcatcgcccttacagcggatgtctatacccttgtgcatttgcagcttgtcagcattcatggggtcggtacgcattccgaacggtgaagtgacaaacaggaactcttcgcgctcgaccgggaatgaataggtgtttgtcgtaaccgcttgcccggtttctgtttccaatccttttgccttcatttctgccatgaccatccggtcatactgctgtagcccgtttgcttcaatgattttttgcagactttgggcataattgccgccacttgcatacccggccttggcaagtcctttcgtccaacccttgtaatcgtcaggagacaggtcaaaacattccgcgtaccgtttgttctctacaaggaatttggaatgatgctcgtaagaatcgcccacgctgtcgtagctgcaaaacttctcgttgggcttgtcatcggtgtaaatgccgtatttgccaccttgcgcaatccaccccggagtggctttgataccaaaatggttgttctcgttcagggccatatggctttgcccgttgctgctctccagtatgccctgtgccaaggtcactgaagccgggatgccgtatttgcgcatctgttccatcgcaaactcggcgtatttctccacatattctttattcttgctcattgctttgtctgtttatcggtgcattccttttgatacctcttcctcttcttcaacttcctctttaggctggtcgtgcttgatttcctcgtcacggctgattttcgtttccacttccgactcctgtttttcggaagaggtctgttcctgtgcctggctcttgttcagcacgtccgcgaaaagcgttgccgccagatgttgtttgaaactgttcctgtcctcggcgacccacatccgttgccattgctgtggtgtgacgcttcggggctgcggtttctggttgtcaatggtgggagcgcagagtatcgccccgttctttgtcttgaacacggccactcgttgtatgcggttcaagtcaatgctttcatctgccgtgtggaacaggtccacttttagatccggcttgctctcggcaagggcatagtattttctggccaattctccacgcaccttgtctatattatccaatgactgtttcagcgtgatgaagaaacggttcaggtcatccttttcgggatagacgctgtaaccggcttttccttccggcttgatgaataaagcccagcggtttttgtcatcctgtaccatctgtatcttctcaaaccagggtttgtcagcatgcttcaccgcagggtgcgcatcgatggtggagagtgtttccaatgcccagtttttcagacgcgccacctctatctgcttttcggcgaagtaacggtcatcgggacggtagcccaacgcaccgtccggattatagaaacgcactttttcaatgccgcttttctccaatgcgctttgtatgcgctgtttgctcattcccttgatttcgttgttcacctccaaggatgcaccggcagggagtatcacatcggcactcttgccttgtttgtcgatgaccaggacaatggtcttgttttccttgtcgggatgcttcttgatttcgtcagccacgaagaaatgcttgggcatttgctcccgcatctgttctgtctggcggtagttacgataggtggcatactcgattttttcgccccgttccgctttgcgtatcacttccagcgcattgttcacatcgctctcgatggcatctatcagacaagggttctctttcagttcacggttccaataatccaccagtttgacactctcgtccgacaaccgggccggaagtcccatttccagcatcttgatacccgaagcgatttcggcaatcagccgttcctgcttgacggcatcctctgttgggggaatcccgtttttcatcaccattccctcacgggcaaggcgttgctggtgtccggtggctgctatgatttgccgaagggtctcctgcgcgtaatcgatgtaatgtgcgaaatccttttgccgtggaatatatatcgcgtctttctggctgtcataatgcgccacaccgctgccatccgtgcgaaccggtgccagatttctcgaaatagactgtacgaaggcattgaatttcggcctgagctcacgcaattccttttccccgaatccttgctcgacactgttgccgtattttgccaatgcgtcatcgtatgctttcctgtcaacgtggggcagcaaagtctggtcgatattgaacaatgtgcgtatctccctgttgtgtacgcctttgtatcggttcttctcttcgggagaaagtttttggtagtcatcccttgatatgacctcgttgggattgttcctgttcacgtacttgttccaattatagaacaggaacggtactcctttttcgtgttccttgacggattcgcctcttgcctttgcttcgctatataaggtgaagaggttgctcttacatccgttcttgtccgagtgcagagccatgaacagggcgttgaacggactgaccgccacgcctgccggataaaacttgggatagccctttcctgtggcattgagccagtggccgcccgcactgaccgccccgtttaacgctccggagagcagttccacttgtttgtcggcggcatttttctcaaactgtgatttctctttcatatctgttgctgttttattgtattcctctggtacgcacaatcgtttccctgtcgttctcttcgtaattctgcgacatcagttgctgggtatggtcgctcttgacaaggatggcattggcaagggtattaagcggcaatgccccggcattgtaagctgacaccactttttcaggcaactggatggtgcagggtacatggtctatggttgcgataaggttgttcccttgcagtatcggaccggaaatccgtggattcagcggttcgtctgcatagacccggtatcggacggaacggtttcccgtattcaaaccgttatcttcattccgtttccatcctaatgcctcgtgtcctgccttgttcaacaaattggcaccgcccagtccgatcatcatcattttgagaataggattcttaatgaatatgccggcgacgatgctggcgataggcagtacattgtctcccaaatccaatgattttgtcctgcccgtaaacatacccaccagaatatccggcaacatggcaagcacataacccaaatttttgcttatgtctcccatgccactcaatcccaaggttgagaaaaaatcgccccagccgttttcgttggcattggcggtttgctgtcctgcctgtcggttctgtcctgattcaatggctgtttcttcccttgattcttccgtcgtttccgtttcattggcttgttggacggattgtgcggtatgggtgtttcccgattgtcccggattgcttgcaagcgcggattgacctttaacctcttctttcttctccatatcctgcaaataagtttccatgtattccggagcgatgaccatcggaatatccttgtatcgctcatcttttatcttttggccggcaataaaatcaaacggcattttcgcttgggcgttatggctcatccagtccctgaaatcaaaactctgtacgggaatcttcttggtcagccgttcattggtggcgatgatataaggattgtcattggctcgaatttccttggcttctttacggaatctgtcaaagacattcctctcacttccgaatacgcccttgctgatgcaatcttcaacggatgctgtgtttcctgttttgtccttggaggaagtcagtgctgaaaatgccaggtcagccccgacaaatttggcgaagctcgcccagcttcccgcaccgccgagtgatatggcatcgatgcttgcaccgatgactttgcctgtccctttttccagtttggacggtttgtaggctgcttccccacatcgctcgatttctgcggcaagcggtgactggttcaatgtgtatgacagcccgaaaagtgtgttctgtgccgccttgcgcatgatgtattcagcggaagacttgggcatattgtctttgaccatcttgcccatcatcaactctccgatacggtattccgtatatgcgtaagcgaggtcgcaccctaattgcccggacagttcatcatatctttccctgccgatttcatccaccacggttgtgcgccactcgtttgccaacaatgcgaggtctgcctgtatctccttattgtttgcaatcttctccctgcacatttccagatagtcctccgtggtcttggagttccattccccggtcactctcagtgtctggtacggatccatcatcggattaccggctgccgccatagaaccgaggataccggctgtactggtggaatatgcagccatttcttccgtttgtttgcggttgagatagttctgcgtgtctcgcatgacaggggcaaggtgactattgaagtagtcaccgaatatcctttctatctccgcaaagcgtgctgtatgcttgatttcgcccatgttctaataattcaattggttcaacagttgttccttggtttgttctatggcgttgtggtatatctccatctgcttggggaagaactcttccagccattcatccttttctatccggtcctgaatgaaacggatggcggccatccggtcgatttctacggaatgttcgccttcctcccggttattgaaccatgctttcgtccaccatcggactccggcacggtcgggatagacggacaccattctcggaatatcgaagctctgtacgtctatctccagttccgacaacgggtcgataatgccactgctggctactgcctcggattgaagtttttttttacttcctcgctcatggtagagagatagacattgtgcctgagagcgagataattgagaaagtccgctatcaggagattctgtaccttgccggccaaaggcaaggcacggctgcctatgcccaaagggtttgccatgctcggcatcgactcaaagaagtagttcttggccgctcccacggtgaacacattacgcagggactgttctgtatattcgggtacgatgtactcgccacggaacaggtcttccatatagacgggaaggaagcggagcatcagttcctcgatttcctccttgtcacggtcgtacctggttttaatctcaccgtcaaacggagtgaactcgtgtgccgcactgtgtcccgatttgccgagtgcctggatattaccgtaaagcatggtcaggaactctatcggattcagttcctcgccgtcaaacgccacttccatgtgaagatcatttccactgatggctaccgtctgacctgcttttaccttttgtccgaaacggatgaatatattagcaagatgcgcataggtcacttcgtatttgccatagcgtatgacaatatatacaccatgctctttgtccgtaccgatacttgacacgacaccgcttgccactgccgccaaagggcggtgactggcatggaagtttatgccgtgatgaaaggatgtctctctggtgacggcatctttctgttccccgtagccttttgacaaggttacttctttattcttttcttcctcaaagggcatacaatagccgcttggggactgtagaatcatttcttccgtgtatttcatttgtagaatattattgtgttatgactgtcttatcttctcattcctccgctatgggtctgttcctcctgttcctgctgtggacgggcttgacgctgattgccggtaacggacgcttcttgctggcgttgggtgttgttgccaatcatcatcatggtcaagaagataccggctatcttgccgagccagcctgtacgtccgaacacgaggaatgccccagcaatcaatccgactatgcttaatcccgatactttgccatgcgcgaggttgctgaaaaagttgcctaacatattcccggcattcccgttggaaacaccacttaaaaaattggacgctccatcgagcgtggaagagagcgaacttgacgcttggctcacgctgtcaaaagtctgttcggctttgccggtaagtttgtttaccgtttcggtagccgctttcgccgtgccgctgatggcgttggtggtgtcttctcctatgacggcatcgctcacgatgcgcaccacgctcttgtcggtggtcagtttctcccagccgacatatccggccgcggctcctacggttgccgtcttcaatgcgcttcctgcccctcgcaaggtctgtgatgggtgcaatacggctccaccaacggctttgcctgtcgctcctgcggctttaccgcctgtctttaataatgaactccagaatcccatatctttttgtttttatattcccgttatgttaaaaagcaccggcctttccgcttcgtttccaccgtttcatggcagacctggctatctctgctttgttggctttgggttgttcccgttccgtgatttctgcccacacgtcacccatcgaggtgtatttcaccgccatggtcagccgtcgcagctttttgttcatcagttgcagcttgggacggattccgaacacgatttccatccgctgtttctccgtcatcttgttgtctgacaggcagaccgtgcgtatgtcattgacaatttccatggagttgtatatcagttcccggtatatcttgttccggttcgtggagagtgctactgccacggcattggcaggacttttcctgagttgcccggtgaactctcccatgttttccgtgagatgggttatctcgtgatagaagccgtatatctgtgcggcgtaactgatgaccgaacggaatgaatccagataatcattgaactcccgttgcaggtcggtgacggcttccacctcctctttcgtccagatgtgtccggtggtttgcaggagcatgattttctcttggttcttcaaggtcttcttggacttttcggtatagatgagaaccattccggcaagggtggggtctatctgcgcgtggactttcacgcctatgcacagcagtgtgattatgataaagattgcccgtctcattttctctttcctccatctttttatcttaccgttgccgccctgcgccacctgttcattgccattcgtgccacttcaccattgttcctgtccagcattcctgccgtcacgttgttccacacgtcagtcatcgtgtaagtcctgatgctcaggtaaagcaggttgagtttcttttggaatgcggacagttggtcgttcaatgcccatagggtctggctccgttccgctcccgtaagcatattctccttgcctccctttgccacggcatcacggagcagggagaataccgttaccagttcggttgcggtctcgatatacaggttgttcatgctcattgcggcgacaataccctgtggattgtcgctgatggctttcttcaacttgcatagcgagataaaaatcctcacaccgtcattgtacaggtgggtacaggctttcagcgaggatgcgaaaccgcttgccgttttaaggtagctgttgtatttcttctcccactggcgcatctgctcgaactctgcggcaatggtattctgcaaaagggcggttttcttctgcccgtccatctggtcttttactttgccgagaatcaattcgttgccttctgccaatgccacatattccaacggattggtcgtgacaatctgcgccttcgccgtgacagacaagatgatgccgaataggagcatcgttattttagtgattggtgatctcatagattccttttcgtcgtttgttaaactctacacgctctctgataatatccacgatattgattcgtttgggcagacctgtcaattccagcttgggcgtggtcctgtccattgacaacaccgtgacagtctttagcccgaaaatctgctgcaataagctctgctgttcgtggaagtccaccacacggtacaattcgatgtaaccgatactgcgttggaacacgccatgctcggcagtcagctgttcgctaccgatgtgatagcgtatgcgtttcaggtatataagccggtaaatcaaaatgagggaaaggagaacggcaaggagggtggcgatagatgcaagaggggcgttctccattcctccatagaccagtcccacgggacaaagcaacagcaagggcagttcgtcgatgaagaactgtgccgtttgcggtcgtagtgaaatctctctgtatatcggttgttgcatggctcttatctgtgtatatttggttgtcggtgttcttcttccttgtcagttgcacaccccgttgtaccgagtgctgcccccaatgggataatcgcgtccttgatgctgtcaaggtattcctcgcttgtcttgccaagcagggcatcgttccagtccttgtaacagggcatcaagggaaagacttttatacggtcggaattgatgtgcatggattccgctatggcttggaacttcttcacgaactcacgcccggcactgtcgttgtcgaaacacaagtagtggtttatatccggagtgacggaaagcataccgcgaatctgcatatcggtgggagtgccacccgtggagacgaacacgcttttcttggaaaggtcagggttgtcccgaaaaccattcctgtgtatctggtagaaagccattgcatcgtaggcactttcaaaccacgcaacgccgcctgccttttgcaaaggctcaccgctgaaattggctatccacaagccctcgctgctgttgctgccctcggctttgcctttgtaacttccgctaccgtccatcttgggacggccgcgttcctccagtcctgcaatcttgtccggctctttgggaagtaccagcggaaaggcaaggttggcatacgccaaaccgtctgaacggtgtctggtagccagaaagaaatggtcggcaaaagcccgttgtgtgaagatgtcgatgccacggttcttgaagtagggataaaaacgcttgtgagtctccctgtcgtttacgtcaaaacggtggatgtcgtaatcatccagcctgaacggagtgttctcctgtctgggttggatgatacgcaaaggtctgtcattgatgggctggttcaacagcctgttgcagacaaggttgaccaacctgtctggagagacgccgttccggtgttccgcaaacttctcagggaatgccttgataaaggatatgatattatagagcttttgctgtggtggctggaaacagcatttgccgttcggtgtgacgatgaacttgtcaccccggatgcgtgtgccgttgctgtccgtgcggatataggacggataacgcaagccgtcacgcttgttcaggtgatagcctgcgtccatcagtatatcctgaatgtctagccgttgcaggaagtcatcgtatgtcagttctccgtttgccatttccgtgttccttttattccttaaaatcctctgcgcatctctgccacctccttgttcatctgcgcttcaaagttccttgctgccacatccatcggcgagtccactcccggcttgaaataaggacgaggtgcggaactgaaacgctctccgtaaaattccggacagggatggtgcagcccgtgggcgacatccgacaacacaaccgcacctgcggcaagtgcggcgaatatcttcgtccccaatccgctgctcatttcgggacgggtcttcatatccacttcgttgaatatcttggaaaagagcttcatgcggtggtagtcatcgactgccaggaacttgtcgtactgtttctggctgatttcatgggtgatgggttctccgttgataatggcggtcatcttgtatttgccctctgtttctgctggttgtacggcgatggcttccacttccacttcacgtccgtgttctccttcccggtaccagcctttgttttcgttgatgtatgacaagtcccgtccgtcaatcaaggctccttcttgtggttctctgatgatatgttcgtcttcttgcagtacggtctgttcggtagagtgcggtgcaaggctgttatcggattccaatggcaggagcaagtcctgttcctgccggttccgcatagccagatcctgctccacttcgggatgcagggcaatgctgatgcgctccttgctgttcagagattccaatgtgaccttatcggaatagtcattttgaatgacattgttcagaatctccaggcgtttttcaaccggatgctcttcaatggaattggaggtcagtgcggataattcctcttctgtcaggtcatagaccatatcggcactgactttctccgactggatggtcagtgttccggcttccgtatccacgatgatgccgtgtgacgaaaggcattcttgccatttctcattggagaaatagacgggtgaggtaatcagctccttgtaaggctttgccggttcttcgcttcttggcttgtttaccatcggggtgatgactgcctgcaaatcctgcaagacatcctgctggaatggctgtacctgctcttgcggttgccgatgccctttgtagtagaatccgtaaccgcccgattgcaattcgccgggtttcatgcgcccgtccgggcgttctgccaccataggtgtacctgcatagaaaagccggccgccgactctgcgcaagtgatagccttcctgctgtctgggagtccatccgaggaaagggggcggcataccgtacctgccgaccctgccatactcaccgatgccgatacggtagccgtgaagtcccattgccacacgaccgttggcgttgcgtgcgtggacgaagttgcggggcatatcaaaatcctcctttacgatgtccgtgaaggtctcgtaggctttcttgttggcatggttcgttccccagtcggtcagggcctgcatctgctgcctgctgatggggtatcgtaacagtggggaatcgtgcccctgtactaccagctggtagctgtcacccacaggtacgacatgggcttgcataccgttgcgcatcaaaagagcacgcatttcgggttgcaagtccggtctcatcgggtttgtgttggttcgtattgccatagtccgtgtttatgcttcaccgctttccatggcggcttctaattgttcactcttgtagtggacgaattgctcggctgccgtatcgtcaatcgtgagcgagtgcgccttgcagtattccaccagttcttcctgccattcggcagaaaagtggttgacgtaatccagccagccgtattctccgcgctccatcttctcgatgagcacttcttcgggataataggtgttttgtgccataattacagtgtttgaaaggttttacttgtgaagtccagcacccatattgcgttgggcactctttttctgttcgttccagagttcttccgtgtattgctcttccggaatatagtcgagattgccgtcatcgtccatcatccagcaaccgtaacagccgaaggtgtatttgtcccattctcttttggtctgctcgttccatttcttggcgtctccctgacagaagcggatgccgtccttctcgtgcaggctgatgccgactgttacaggctcgtcttgcatcacaaaggtcagcggttcgccctgctgcatcaccttgatttcggcattgctgagtttcagttcttctgccatcacctgaaggttccgggcgatgacctgcgtggggacggacatgacctgattggtctcggtatcgatctgtacgaaggcttttgtctttcgcccgtcagccgttaccgtgtcggcaagaatgactttgccggaacggagctgcttctgttgttcctcgctgtacttctccaaggaggatttcttcagcaccgggtagaacacgacatcggcttctccgttctccttgcgcacgaaagcgaatcggctatggtcggtgaccgtgtttccgttatcatcgtttaccttgatgggaagcacaggcgagtgcctgccgtgactgagttcttccaaaatgcgcataggaaggtcttcaatcatttcctgtgtgagtccgaactgcgagagagtttcgtaaggcagttcttcaaattcaaatcgtacttgtttcatactttaatatgatattttgattatactttggcaaaggtatatactattgttcatacttcaattagtgtagttctaaatagcctaattatttgtgtttatttatgctttaagtatgattataatgcagtattcatactctgaacttatttaatgttatattttggaggtaaatcaagacatcttttggcacggtcggagaactgttcctacatttgcatctatgagtaatacacgaatcgttatagcccttcttttgttattatccgggaaccatgtgaaagcgcagttcaacacggtttcctgtccgggcaatcactataaagtcgctgtggaaaccccatcccggacgtcaaacggaacagaggcgacacccgaaagcatcacctctgaaaacgagaagtccgtacccgacaaggttgctttgtcaagtgcggactcaaaaaagaaagagcaggtagcacgctatctcagcgtatgctatccgctctcgtatgtcaagatcaattcaccatatggctatcgcaaggatccgttcaccggaaaaaggaagtttcacaacggtattgacctccatgcccggagtgccaaggtgtttgccatgatgcaggggagagtgctgaaggtaggacaggataaagtctccggaaagtatgtcacgttacaacatggcaacttcaccgtcagctattgtcacctgtcgcaggtttctgtgtcgaaagggaaaatagtcaaggcaggggaagtggtaggcataaccggcagtacaggccgcagcaccggggaacatctgcatctgaccattcgtcataaaggagattatatcaatccttgtatagtccttgattatattcagtcccaatccaataagtgggacgctgtcccatcttttggatgaatcatacgtgggtgtctatttttacgcacttacgacctttaagtcctatcattcctttagtaaccaattccattgcaaggtcttctgcatcactgccgctcactgctgagactttcaaggtctcatgctcgtcaagttcggtggtaatctctaactggtattgatgtatcacagaaatgcaatcgttttctaatgctctttctgtcatttgggatgtccagatgattttagacaccggtgccttgcggatgtttttcaacattttcacctttacaggagcatccgttccgtcttcgtttacttttctgaatcgtttgcatccacacgaacagcaccaaataggtggacggagaggtatattgtcgccacccataatggcggtcttgcgatattcaagcatgaaatccatttccgtcatatccccggtgccatacacaatatcaacgacttcactgccacaaaccggacattttgatggcttgcgtgtcacgttgataatttgtggtcttgtatcattgggcatactcatatcattcaaaatacttgtttaaaaaatcttcctgaaattcattgagctctttgaattgcgtgtgtcgattgataccgatctcttccaatgtatctaatgacaattccttgccttcgtacattgtaaaagtcggtattagtttataacaattttcatcagcctgaaatggcgtaatccaacaagaactatcttcacgaacacaacttgtatcaacgacttcaagacgatagcgtacttgataatgccccttaccgataagatataaatagcatatatccccaacttccaattttttattgcgagactttttccagtaagcacatcctaaagtttggatgctctttacgtggtcaatcatgctttctttcccttttaataaaaatactcgtattggcttcatatcctatagttgttaaaacaatgtttttatagattgcaatatacgttcaaatcaatatttgatacatccttaatatatgaagagacacaacccaacaaattaagtatgtctgggcttggatttgaacagcttaatcctggttgcacaatattgatgtgcataatcagatcttttttccagttcacctgtgagcttaattgttcgagttcttcttcagtccctttgagtattctagaacattctcttccttgatatttttttatcttccgagcaaaaagacgattaaataattggcgacttttatctctatcgttccattttaagcatttttgagcttgtccgcaaacctcataaaaatttgaaatcatattgcttatttttcctccatgtgcgtatttgagatgaaataaatgcatgtgtattgcattattttcatttttgaatcctattaaatctgcaatttctccgctaccgtcatcatcgtaaatcagatcgaatttttccgagatgtatcttgaaaaatagtattgaatagagtccgtctcataaggtactacatgttgtgattcattttcaattttagtatccgcccaatctatacctatcaatttttcttgagggaatgggataatatcggaatttacacgcactaaattattagcataaagacatgaaccatcagcaaaatatataacaggtgctgcatcgtcattattaaaataatcacaaatatcatcatagagacgagtaccatatctcatttttagtttatttccccgtatctgtttaacgcgatatattgggcggctatcctgttcggaatactcgattatataggtgaatttagaatcctcaataagtatattaaacgtaattgtgctctttatctcgtaatccgctaattcaatagtagcataccataattgatagtcaacaaggttatgagataagaatattccatgctctgggtaatctctgtataattccgggtcccaatcaattgcaataggtgcaatttggggtaattcagaaattgcttgaactcttaaagtgttattgataaaagaattaggatctattttctcattttcaactaacttcccaatcattctagcccattttgtgtattcaagtagattacctcttgtatgactccatattttcccctttacagaacaacctacactaaccctttctccacgtctatagccgttaccaaacaaattattcgccgttaattgtttttgctcagtcatggaaataccttcttgaacatctttcccatagtaagacttaaacgaaacattacccattcgagcttttcttcctccaaaattaacaatggcaaaacgtcttatatcgtggaagacacgaaatacacagtgccctgaaattttacaggtatcatcttcgccaaaaatcgcctttactatctcatccgtttcacttaaagtactatatacgtaggcgtggttatatttgggtgtacaatatctatgaatgacaagaatattccaaagtaaattctgtacacattcgacattaccccaatcaacattttcaatgctgcctccgattacaactaatgtatctccatctgtggtgctacttccgaaacgataatcataaatctcaggagatagtatattttcccaagctttgggattccacgtgtttgaagttcgatatatgactgcacttaatggaatatttatactttggaatggaatttttgataattccaaattgttaaatgactggatgaattgattaaaatctttttcttgttcagtcgttccatcatttaggagtggcaacaagctgttccaatctgcatccttagcatatagttcttctagctcttccaatattggaggatatgcaatgttcgtaataaaacttgcatttccaaggttagaatcatatgatgtacgtgtaaatcgacctatgaattgtaaggtgattggtaaactctgctttgcgtcgtgaattgctgcaatctttaattcaggcatatcaaatccttctcccaacatatttacgcagacaataattttatgttttttgtcttttatgttgtttaaaattgatttttggtttggcattgaactaaataccatcaccggatttaaatcagagtattgctgatatatctccattacttccttggctctttgttttgtactgcatctagccataagaatatggtcgtatccattctccatatcagaacggagttgcttaacagctacctcggctatatgtttatcagcttgaattaaatcatactcccttattggaataaattttataggtttgtaatatccctgcgattgtgcatcttttaaggaaaagttatatataaaatctccttttaatcttcggctatcatttctgaatggagttgcggtaaatagtgtgactttttcatcatcaaaagagtcgatgaactcgctccatgttttagcttcggagtgatgtgcttcatcaacaaatagatgacttatgttttcctttaataaatttataatctccgattcgcaatttgtaataagaggcatagtcgtgattataacatttgatttttcaattaaagtgtaccaaccattataatccataccttccttaacaataccaacattcggataagagcaatcacttgtaactattccaaatttgtgaagtacgcccaaagtaaaaaatttatttgctaattggtctcttaacgcatcagatggaacagttacaagtactttggcacattgattcgcaatgaggatacttaacatggtttctgtctttcctgtcccagttggcatgactattatatttctgccatgatgaatttgagcctttgacataaacgcatatatagctccaagttgcggagcacgaagccctaaaatggattcttgaatattttccttcttataaaggaatttacctctccaagaagctgttatttcctcaggacgtaaggtgtctattttggggtgtttaatccatctgatagataaaatatttcctctaagaaattcacttttgcgaggtatcttgtttgttaatacgacatattgataaccatcaatactatgatcattttcatctcgcgtaagaagtatttctgtattatttgcgcgtataacaaagggtgaggtggaaacaatatcaaatgtagcttcactaaattcagtagcaaatccgttaagatgctcaactcgattgtttccacaactccacaaaagttggattatttcgaaaggtaattttatcataatctaatcttgcttatatcaagtgcgttacattgattttcttgtactttttgcccatactcagtgcaaaagccatttggtctttgattatcagctctcccttttgaagcccagcaatggcagtgcgaatttcttgaagttcattgccacttacaccaaataaatccttgataaccttgtcatcaatagtttgctgcttcataatgagcggatattgagcattggcataaaagtcaaatcctttgctcttgaaactactcatattttgtgtggcaagaatgatgcttaatcccttatttcgacctacggcaatcagattacgcagaggacgattgtcaaagtcaagcatatagtgagcttcgtctataatggagaaatggcgtatctgaaccacatcgtcgtttgttgcttgcttttctaactgttcatagatgttattcagcttagagattaagaagtacacgattgccttggcaataggcccgtccttcggataaccatccatcttgatgatatagcaatcaccaatcaaatcagctttgtcctcttcctcaaatatattggctcgtaccaactgtttaagtacagacgaaatactgtcgtcttttgcagggtcggtcattttagcttgatattccttcaacatcattgtgaatgtgataggcgatccgctggttttcttatatgcttcaacaatagcctcactcagccggttattcatattggcacttgccgaaactctgtcaatggaacagagagctgatgccatttcagacgaatagagattgatttcgttgataggtcgccctgtaaagtctttgaacggagtgaatggaagcggatgctcgatggggtcaagtatgcaactgcgatccacatcaaagtgagagagccaatgattgttttggatatcgctaaattctcctttataatcgaataacagaaaatttacaggatattgcgattcggaagacaacgctctaaattgctgcatcaatacagctaacaagtttgtttttccagatccggtagctccagctatgataatttgagagttggtaatgttgcggctgttgatgtcaaggttcgcttccatttcctcgtctccatagttacccacaagtagattaagcactggaatgtcttttgtcatagccaccttgctgcccatagaatacaaatatgtatccaaattgttttcttttatcagataatcacgaccacgaagcatttccgctgctatgatacgtgaaagggtggcgttctgggtccagtcaatattcaaacttgaatatcgtaatttcaaaagagctgcatatagggttgacaagtcgtgcatggtaaagaaactggggacaatacgtgcagaacttgttgaaagctgaatgtccttaaattcttcctcttttcgctcggcaggaatactcagtcccacaatgaaacagattctcattaccttattgagggtaagactcacacgcttttctctgtccacaatacgagacagattgattttattctccatcagatctttgacaggactgatttcatccagcagaccttccatttgacgtgtatttgaaaaattgatgatactcatgtcgttactactgattaagcgtgataccaaaatagccttcatctatggttgtccgttgctcttccacattcctatgtagggtataggtctttgagataaatggctctaactttatatagtcgctgtccgttctgatttccgaagtggtacacaacagaattgtctgttctgccaactgcgggaaatactcttccataagtgcatcacggctttcattatcaagtacgcccatcaccgtgtctatcatcaccggtggattatagtcgcctaagttacgaagcactttcaaaagaacttgaatgaatatctgcttggatgcagcgttgagttgattcaatgagatttcatttccggctgtatggtatagcttaatattgaatttttccatactatcggataactcaacacgcccaacatgtcctttataggaaacaagcaacttgtttagttgctcttgcatttccgtttctatctgtgcttttttctttttcaaaagcatatctgccactttgtcgaagaatggacgaagtttcatcaatgtgtcatacttcaaatccggctcttgctgtatctgtacatcgtattgatgaatgcgtttctccaaacgttggatttcgcctttcaagttgccttccagcgatttttgcttttctatattatgtttggcttcctcataattggctatcagcatactatttccaccggaacgagtctgttccaatgtgcgcttttctgatttcaaattatctatgttcgctaattgaacctctaattcttgtctttttctgtcgatagaaacgaactggttatgaccgcctttgccgggcagttcacgaagagcagttacttccgaatcgtctaaataatcatatggatcttctgtattggtagcattctgtaaagctaccatatgtgctactacattttcttcatccaccgcatgactacatagggacagttcttttagatattctataattttggaggttacatcacgtaacgtttctatcggataggcaccggtattctgtttttgtagctgctcttttacacggagaagattgttgatttcctgcgacaggtttgatgccagtttgggcaggaacacattgatttcaatgttctctacaaacgacttcaagacctctgcataatttgcagcttcgtcagtgatgttttttattttgccgtcaatgtcttgtatgcgtttgttcaggttggctgtttgttgcgcaccttcttttgcacgttgatactcttcttctaccgaagtcatatatttgtacagcctgtcttgttcggcaagacattcattcaactcacttatcaactgttccttttgaccgcataaggcattgtattcctttgcttccttttctgcttctaaacgttgttgcgcccattcctgctggagtttttctgatgcgtgttttagttgtagatattttttgaaaccgagcacgttttcaaagttatctcgaatggtttgctgaaagacgttctttttcagtagttcgctcgattgcatggcatcaaacaagaaatattggctgagttcctggggaagattagccttgatgattttgtttatctcctgttcggcacgtagtctgtctttggcggctgtcatggtaccatacacatacatattgccattcatgttgagagagacactttcgagaggtcttccttgtggattaagcacgtaggttcttttcaagatgtatttttgctgttgtcctaatactttgcctacaaatgttatttgcagacttatctccggcttcgctgtatttatagcaccttgattgagcaattcaatgaaatgttctttgctctctattttcaacccgtacaaagccccactgatggcttcaaatagagtcgttttaccaccaccattcgatcctccgataaggatgattggcctgtcatcatccaccgtcaaatcaaggtcgagggccagataggttttatagttgcttatttttattttctgtatgagcatggcatctaaattttattgacgaattttctgaatggcgttacggataatctcttccgtatcgttgtcactcatttctatcacatctactttcttagcgtgatacgctttaagtatgtcttcactaagccaatcaaagtcaatctcttctttttcacagattgcctctatcatagccaagtcatcctttcggatgccatagtgtacaaatttggggtctattccttttgccataatcatcatgcgttttgaggatagaaacaattccagttcaatgtgtcggtagtgttctttatgggaagcggcgagaacaaccagttttcatccttccgaagaatgacaccaccgtagagcggctgttcttccgttgtgttttcttttatgtattgcaacaaggcgttatgcttgtcggacgcaaacacatcgctgcctatacttttggtatcgaacagatagatatgtccgttcttcatccggattacaaaatccacgtagaagagtgattttgcctgttcgtctccggtggtatattctatggcgtaatgctgtttgcctttatccccgttcttataccaccagtctatgtattggctgttctgttctaaataggcaacaaaatctttttccggattcgaagcctgattgagttgcacaaatggcagtagcgcatgattaccggtttcttctatgtgacttgtttcgttatcgtatgtccgttcttccggcacttcccagccgtatttcctgaatactctttttgctgccgattctttgcgggccttgtcacggatacgggcatacctttccaaagcggagtcgatgatacggtcgaatttggggcggttcgaatggtagagtaccacttttttggcttccgtctcatagattccaaagaaatcggcaagtatctctaacaggtaacttgctattttgtcagttcttcctttgctctcgaactgatggcctttagtggcaatgtatgccataaacacacggtctatctccgtggcttttctcgcgtattttacagtatcaacttccagcacctgttcttcattttggaagtgtacatcttgcggtatctcgatattgatgttctttacatcaaggcgcaaggagttagccacctttttcctgttttcattgatttgaaggtcatcgctatccggcaatgtattgctttcttcatcattatccaacttggccaactcctccaacgagaacagcaagttgccttccacaaagtcccaaaacctgcgggcttcttcgtgtaacaccttacggaagtccgggcctaaatagttacgttctacattggggcgttctgtatagcttgacggtaagtttacatttttcagattctcacggcgatgcgcggtaatggtattgttcaagatatatccggcatccgccgtaacaatctgtatcttgtcctttgcgatgtcggtaaacacatagccggagttcagtatctccttttgataatgtttctgctccggcatacgcatgatacgccccactgtctgtatggtaaactggtcgctttgcaatttgcggaagatgagcaataccgctgcgcgagggcagtcccaacccaaggcaatcgcctctttgaaaagcaatacctctgtcaggttatccggcttttcaaggtctgtcagattctctttctcgccggcaagccatactgccagccgatgattgtctgttgtgatgccacacatcacttcaagatatttctttacttggtcggcgatggctgtatcttcggctgtcatactctctttggtgtcgttaggcaactgaatcaacagcaggggattgacgttggaacctaccgctttatacgcttcggctatctggttacgcttgtccaatgccgctttgataaggttggcattgagttccagttcatcactgaaattcagctctatttccggattgagcaccacttccttttttatcatttctgcagcaatcacatcctgacgatagaccgtgaccttttcctttggattggcagttttgggagtggcagaaatacgaatctccacagtcggattgattctatcgagcacggcagccgacttgtccgctgtcttcgaccagaacatgtgttcctcatcaatgatggctacaataggtaggccgaattcctctttcgtcctgtcggttatttcgtaaagcgaaagtgaacaatcaccctcacgtaccattacattattctccttattcacgctttcccagtttacaaagagtatttcaccgggacggataccttcattctggtccagttcatcgaacattaccgggcgaagcgtgcgtgtctcctcgaatgcgcctttcaatttttcataactctgtatgtgcagtttgcgtggggcaaaccatataaatgccacttcctggtaacggctgtcaccacggtcgtgcaattcgtccatcagtcctgccagcatctggcaagccatcacggtctttccggctccggtagtcgcctcgaacactaatttattgcgctgccctccaaggtttaacaggcggatagttttatctaccaattcggttacggctttctgttgatatgctaaattcttcattgttttccgtctattcctttaattttttctgttccttttcaaaattctccaagaaatgaatttccacaggcgatagttcatacatggtccgttccttaaacttatcatattccatatcggctttctgtttggctatttctgccgatattctgccagcatgggtaagtagttctttcccggatagtttgagaaagtcgtccaacttctgaatccagtctttcatatacatgggctggtgcgacttggcttgcagttcagcaaaatcaaggtataggctgactattctattgagcgtatccaattcatcagccgaaagatagtttttcgctacctctgcatcagtacgtttaggcattgcgcctgtccacgaggtcaatcccatgaaatccttttctgcatcggcacgttcatatattacttcagcggcagtgtgtccgtgagcggaaaagtgcatcttgttctgtacggtcttgaaaaagagttgtgtggcttctgcccgtgggtcatagtctatgcttaacgcatagattgccaaaacctttcggtagaacactttttcggatgagcggatgtcgcgaatacgtgcaagcaattcgtcaaaatagttgccacctccggcacgtttcagcagttcatcgttcagggcaaatcctttcacgatatattcgcgcagtacatttgtagcccatatacgaaactggacgccacgatgtgactttacacgatagcctatgctgattatcatgtcaaggttgtaaaaggctgtttgatgcgtttgttgcttacctatgatagctccgtgttgagtggttgttgcaaaaaacgcaacaaccatatctgcctgcaactcaccctcttcaaacacgttttttatgtgccgtgagatggtggacttatttctctgaaacagttctgccatttggtcggcagtgagccacaccgtatcgcccgacagggttacttctatcttcgattgcccatctggggtttggtagagtatgatgtttcctttatcctgctgctcgttcattgctcgtcctccttttcatcaaaattaagcataccgttgaatgctttgtcgtcattgctggcagcatcgttttcttgttcaagagtgatgtcttttttctttggcaggatgcgcttgtaggcgttgtatatggcctgcggaagagcgcaaagctgcactttgtcctgtacctcttcaaattcaccttcccacgggtcttcgcttggcgagaacacatacacgcgcatcttcccctcgtaatcagtctttcggataaggtctgccaacagcggcacggcctcttccttatatataatcatcatacgcttcttgccattgtcgaaatagcggaacacattcttgtaggtcggttgttcaccgaattttgtctgttcggtatagaggtcttccttaatgcagagcatatcggtggagaggttcatcagttgacgcatattcttcatgctccggcttctgccgacaaaacttgtacgatagtagcgcagtgtgttgttctttaagccggtgacttcttcacctttaggtgtggtgtagccattgattacccgtttgtttcgttcgtaggtcacttcttcgcagatgttattctcattgttggtgacgaggatgcacttgcggtgcccgccatcttcagcattgagttgcatagtggcgtgaagggtggtaccggagccggcaaagaagtcaagaaccatagcgttaggtgatgttacaactgctgaggatagtaagaatttcacaaaggttgatggctttggaaaagcaaaaggtctaatagcaaaaatattagctatttctgctgtaccttgggctgtgttgaacaaatctgatgtgattagattcctataaggtgttgtcctatctacctgtctgttagagttatctactttttggtaacgcttacaatatactgcccattcatttttgtttttcttaaaaacgataaaatcattatctaacccccattgaacttttgttttactccataaatagttccatccttcattctgttgttgtcctccacccgggtatcgtaaagttccatctggcattttaattggaaaattaagtgcttctgaataatgtccccctactcgtcttcgatcaagtttatccaaagtataatgtcctctctctttgatatgttcatccgttagtttaaatgtatcatctgaaggtggctgtccgtcaaaatgagcttttgaacgatttgcagtatagactaaaacatattctgttgttgttacaatttcattccctgtattagagcctgctgttgactgccatataatattggttataaaattattatttccgaacacttcatcacacagcaatttcaattgcgcttgttcgttatcatcaattgagataaagataacgccacggtcagacagcagttgttttgcaatacgcaaccgcttgttcataaacgacagccatttggaatgacggtagctgtcttccttgtcaacaatacagtcgttatagacaaaatccttgtttcccgtattgtacggtggatcgatatagataacatcaatctttccctcatgcgtgtaggcaagtgaggtcagggcttccaagttatcaccctcgataaggatatggttcggtgcattggcatcatcgctgattatggctttcatggcatcctctatcaataccggcaactcatcccgcaaacgctcctccacatcctccggcttatcctcccacacaagcccatacttcttttgcttgcgcagcaggcccaacagttccgacttttcttcgtttgtcagtccatcgagctgcactatcttattgtataattccgttttgttcatatccacgtattatcatttaacgagtctgacagtctggatgctttcctccaacgaggagttcaacaactctttcacatcaacattcagcacattggcaatctgcaacagagtttccaatccgggctgtgaggtgttcgtgcaccatttagacactgttgccggatccttgcccaattgttctgccagccatttgttggttcgcttcttttcaacaagaacgactttgattcgatttatatctttcgtctcttccattttggtttattatttaccttaccatgcaaaagtaatgaatttattttattcagacatcattcaagttatatgattttccattgaaattgcgaattagttcaatattcctgcttatctatgattattagatcaggaaaaagggttatctttgctctatagttattttatgataagactggtacataaagaatggaaaattatattacacctcaaatagtcaggtatcaaaatgtgtatgatctgttagagaataacagaaccacttcgttgtttggtgtcgaagaaaatttgtcaatagacaaattgcttcaagaaaaatttgtttgtatagtgggtgaacctggtattggaaagagtcggcttgttgatgaaataaagaagcaaatttctggtcatttgtatttatgtcctgcatctaaatttaatttagaatccgctccgaccaatgaggatttctgcataatagatgccttggacgaggttgagggaaatatattccatactgttttactttcaataagacaatatagggaaaataatcccgaaacaaaggtgctatttacttgtagaaagcattatgtggcatcttataaaaagcatttctcagtttgcagtgatttaatttttattgaattatgcaggttgagtgagcatattgtaagtgatgttgttaattgtagatgttcgaatataacaaacgaaaatatcagtaaaagcgcaaagttaaaagagcttctaacagttcctagatatttgacatttttattggagtatgatgagaaaaaaggaggatgtttaaatgtcggagaactttttgagtatatgattgtccgttcaatacaaacagccatagatgtttatccgaacactacgaataatgaaagtgttaaagttcttatacaacgagtattggaaaaagtggctttcattatggaaataagcagaaaggatcaaatttcaaaagatgaattatatacggtcttagatgaagtagaaggcaatatgacacagatgcttattgctaattttgatttgttattctttgagagtcgtatattaaaagaaacaaatgggatattgcaatttgaaaatactgaactacaggaatatcttgctgctaaagaattatgtaggcaggacaatattgaaagtgtactttatgatgttgctgtgcataaagaattgaaacgtatttacataaactggtacgatgttattcctcatatttcatatgcggaagataaaatacatacatttgttaatgtgctaaaacttattgtggcatatgaatctaatcttgaaaatgagccatttgaaactttgctgaaatatatagattcttctcttctttctcttcaacagaaagaagagttattcttcatcatttttgaccactatcaacgtgtacctgtatatattaactggagaggggcaatttgcggattattacaagaatgctatacttcaagttgtaataataaaataatattggctgtagaacggcttaataagattcaaataacgaatatctgtactatattggaagtaattgccgaagatgacaaactgagcaaagaagttttcgaccattggaataatgcagcaaatattctcatgcaaacaggcgatgaggaaaaacaactggtggctttaagtttgtataatgcactaaaaaatgaagacgaacttgtcaaattatctggttcatacagtcgttttactgaaagagtgaaagaaaaatactgtgaagtgaccggctatggaaaatttacaaataataatgttgtagattgctggttggatagttgctatgcaagtgattcatatgcaataaatgcagtactatttataatggatggtcctacaattatttatgcgtataataagattacagaagctaataaacttggtgatttttttaatcataataggactttacatatccattatgagtggcatttaacgaaacaatttcatattgcgtgggatatagatttagaaagtaaaaaactcatgacaaaagttattgtgagtttcattaataatcatctgtatatgagctatacagagatcaatcctattattaaacaaatactgcttgagaaaacaacaggatccttgtttattgatagttttgatagagtatgggatttagaagatttatttcgacattttgatgcagaaattgttgatgctgaacttatatcttctttagacaaacttttacatgaaataaagataggagaatggcatatagacaatattctaactgctcttattagtaaaatcagaaatgatgaagttaagagcatttctatatccgaatacataaaacgttatgcagagacatttgaacgatgggatgaaaactcaaagaaaaaagtagaaagtcaaacaaattcacatgaatatcagcgacttattgattcttatcaaatcctttcaaaactaaatgtacacgaattctacaagtatgaagctgcatttgaagtatctaaaaatgtagaatttatacaacaacaggaatttattcaaccttttgtggatgttattgcaaaatttttcacagaactaaatttggatgaaatgacattaaagaagacatccgaaaattcttttaatctatctacatctttaattaaaataccgtattttgttaatgcaatttatcggttaggattccgtaaagtgttggaagaaaatagaactgttttgataaagactttacctgttgtctgctgtactttgaatgctggggccaacgagataaaggaaatatacaagtctattatttgtagtattagtgatgatgagaagaagcaacttgtcgaatggtggaagtcaagggaagatgattttatgaatattagtacggaggatgttttaacctgtattaccgattatggaattgatgctttgtcctataaagtggaagagtatatcgaacaatataaagccaatcaagactttagtcacagtattgctgcatctaaagctttagctcttgtatctgaagggtactgtaattggaatataaataattacagagcattgttcgattctcttgctgatgatagtattggaagcataaaaatgcagtgtaatgacataatgattgaaaaatatcaagatccagaggcaatgacatggaggattgaatatttaaaaaatcatgttgtaaagtctctttgtcgtaaaactgggtatgtatatgcggtttctaaggaagaatcagaaatgacacatccacagatgttcaaatgctttatgagcataaaaaataatgagagactgattgaacaaatgtttgatttgtttgattttggcttatcattatgtataacttcagagacacaggaatactcaagctatcttcttaatcagatatgctttttctttataaataccaataatattttttatatattagaattaagaaaaaaggtggcgtattttaatgatacaaatgcgagttttctcgtaaacaacattatggataatgctgaaataatgtatttgaaaaaagaaaaaattacaattggtaaagctattaagcaatacaataaatgcgtcaaagaatcacatttggaaatccggaacgataacgatttaagacgatattttaattatatttattctgaggttcaaaaagaaatacaagaccaaggtatatattctttagtacgacaagaggctttaagtgaagattttattcagagggagttgaaaaataccgtcatcaataaatgctgccaaatgggattagaggctgttcgtgtagatcgggaggttactctacaagataataagcgtacagatcttcttattcgatatggtttatgtaatcctattatggtagagcttaaactgcttcacaataaagaacttaaaaataaaaaagaacgtcaggagtataagaaaaagttcatacaatacactaatgcaacaggtgcttgcttgtctgtattttggatatttgatgttcataaaaaaggtggtaattgttctaattttgatgatttgaaaaatgaatacactgatttaccacataccttagtattgctaacagattgtaaatgtagtagttgtattgacactggcgtatcaaaaaatggaacgaggcctaaaatcaagaaaactcaaaatagaaaaaaataaagcattattggggttggaatatgggggcaatgcctgatgatttgcccccattagaaaagctatttcactttatatttctgaatctcttgtatcatttccttgacatcttctccaacctgtacgaagttcttgtaaaggatgcgttcccgttcatcccttgatttgaaggtgtagaacttgggaagcggtacatagccggcttcttccttttttatttctttcatgtcgaagtctgtcttgcagtaaaacttggaggtcttgaactcctcgctttcctgaatgttcatgcttccaccgcttcctgtttttgtcttcacaaaatcacgggctgtctgaccgcatatccatccggtcggcatatcggagattttggatgcaggaacaagactgtccatgttctcattgaggttgatgctggttttgtcccggtcgatggtcacgccctttttgagttgtaccaccttgccgaagatgtcggaagacagccattccaaggtctctttggaacgggcagaaccgctgaccacattgccgacagtggtgataatcttctgcatacctaccttgccataatccgcttcgagctgcggaagttcctggaatcccaacgccactgacaccttgttgcttcgagccgtaccgataaggcggtctatcttgtgaaaatacaaagtcggcagctcatcaacgatgatgcttaccgggatatttttgccttgtcccgtgttcactcgtgtaaccagacgattgaggataagggcgttcagcgcaccgatgatgctctccatttccgggtcattggcaatcaagagataagaaggacttttcgggtcagaaactttcaagtcgaagtcgtcaccgtccttgtggaatatccagtaactttccttggtggcaaggcgtgaggtatagacacgtagcgtaccaatcataccttccaactgttccattgccttgttcttcaaagcggtttgaaacggaccgagcaacggcgtcacctcgttgtcggtctccaacacctcgaaaatggtctggtaactctcattgaggaatgacaggatatgtggcatatcggaatactttccgagccaataagccggttccacttcctcgcctgcggaattgaacacccgtccggtgggtatcatccgtttggtctgtttgtcctgtaccttctctgccgtgagcatattgccgtccttgtcgtatggctctttgccccagttgcagaagaaatagatgcaggctgcaaggaagttgacagcggatgtctgaaagaactggtcactgccaccgcctccttctttcttgcctttttgtaaggactcaagcagggtttctgcggtttcagatgcggcagcaaggttgttgatgtatttcaactggatagggttcaccctcctcgaatactccacatcaacgaaattgatgatgttgaacttgcaccccttgggcagatttccgagcttctggtttttcttgtaatgatagtataatttggtagccaaggtcggaaacttataatcgtaaacgactaaggcaaagccttttgccgagtgttgccggataaacggttcgataatggagaaagtcttgccggaacccggtgtgccgaccacccatgtgcctcggaaaggattgctgatgttcacccaacctttgcggaacttccccttgtaatagtagcgcatggggatattgaccgaatacttgttctcctgcaactcccggcactgctcaaaactctcattctcaaaattgaaacggtctttcagtaatccctctttgaggaacttggaaatgttgtcaagggcaatgtgtaccagtaccacaccgattattgaggcaagcatataaagccagatgttcaaccgtaaagtgtaaagccttgtttccatcggatatccgaacaaccaaacagacaatacaaccagccccatacctattataataggataaagaacttgtttccgtgcattgaactccagtttcttcttgttccttgtccctatacaggtgatgcatataagcaggaatgtggctaacttgctatacgcgagattcccgtcattgtagattacccaccgcttgatacgcccgtgtatgtcgcagagtatgccgccccaatggtcaagcatggccgggtcaatggcatactcgaaaaactccagcagaatggagacatagatgatcgaacggaatatcttgtaaaaaccttgtaactctttgctttcttccatttcgtttccagttattcgctaattcttgtatattctgattcttaatctctcaaggtaatgattgctcgtaccttgtgcgcctgtgtcttgggtgtttcctgcatcgagccgcttcccatggaatagagccacgctttcgccttttcctgcccggccacttccgtactcgtccagtaccagcagtcatcggctgcatcgggcagttcgtcgccaccgcacatcctgatgatggggtttatctggctcttggcattatagagcatccgcatctgtgccacggatgggatataggacgactgtccgtaccgccacagggcgaagactgcttctgccataggcgaggtggtttctctggtgtcgtagattgcaaaggtgttttcgttgccgtccagtgccgtgatgtcagtagatgtgcgttggtttacccctatgctatctgcaaaagcctccggagccaagtcccacaggtaaaccgcatagccgttgccttcaatggcttcatcgtgattgacatggaacaccacggcaatgggctgtttttcggattgcttgaagtctgataccgacaacactttgccgtccgtacacaggatatgacagggcttcattgccgtgtccgggaaatcccggtgtgcgtcacaggccacgaataacatgacgatggccgacagactgaatagcctgcaagcgtttatgtataatttctttttcattttcccttagtttagaggtaattttacacctaagacaatgcccgtgcggaacaggtcttctccttttatcatcaaatcggttttcacctggcagaaaagtctccagccacctcgaagtacgtaattgtgttcatagccgaggtggatgccgcccaagaaccgttttgtgtcactcccggccgatgccccgatacggacattgccgtaatggttgcgaccacgcgccacacaaggcttgtaggctactccgaatccgtaactcctgtaattcctccagaatgattccggacagatatgaccgcaggatgcgcattcgtcccatttgagataaccattggcaaaaaactcccatgtgtggtggtacttgccctcatgttcgtatgagagggtgatgtccagcccgttttgatacaggcaaccgacacccaacgaaagacggtcgctgttgctttgcgctttaccgttcatggcaaatgtcattaccgtgaccaataccaataatatctttttcatcattcctcctccaataatacacggttaaacgaatcggctgaaagcacatcctcgtagtctatattcagatgtatgttcctgccgcttatctgtttctcggtcatttcaatggtcagtaccttgtcgttggggaaggtcatcttcttcaacacgatgacattgcggtagccatgacggaatgactttgcctgttcaagtaccaatgcgggagccagctctatgatttgggcgttggtcgccttggacaacttcttgtccgcgagttttacccggatctcgtcaatgtcaaaacggatgtttgtcttgttctcaatggagaagtcaatgaaaaaataatcaccgaccgcgtagatgttgttcaatctcatcgtcatgcggtgttcccggcttctcacgttgcggtatttggcaggagagttccatatacgcctcgcaaactgtgtcatatccgcctgtgacatactcacggcaggattgttataggcgttacgttcccggaactcgatttccttgtccgtcacggcttcctgcatccttgtggtatagagcaacgcatactgggtacgatagcgttccgtgacaatggtgacgatggccagtatctcaccgtcctcgtatcccgtctcctttggtttcagacggatcgtgttgtttatcggttggtcaccgactactttgtccgtggaaatatccacgaagcgtataggttcggaagcggtaatgaccgtggtcacttgctcgttgacggtcagttgctccagttcctcgtaagtctgctgggcgaatgtaggcaggctcgacaatgccgccgttactccgatacagatagtcttgataatcttcatatctatgattctttgaatggttatttactttgcatttcttttttccttgctgttgatgatatagacaaacgtaccgtatttcaggttgaccttgttctttttgatgttcttgctgatggcgttgctcgtcttctggtaggcatcctgaatagcctgcattccccattgggtaaggctgttgccattactgccggtattcatgttcatgttgctgttgaacgctccgcttgccacatctttggcggtttccctgaatgaacttgacggcacatacagtccctccagtccgtcggtatcatagagcgaaaggctgaccttgatgatttcatcattcaccagtacgctgttaatggttcccttgacccgctgcgaggaaaaaccgctcatgatggcatagagataagaaccgcttttgaccaccgtctcattgatttccacatcatccaaaagccgaagcctgacacggcttccgttcacggccttgacatcctcgtctataatcgccttgatcagattaggctcatgctcgttttgggcaatggtgttgaaatagtcggaggtcacttttactttcttgatcatttcacccggttcttcgttttcggaaggagcgtttaccgcccggctgtcttcattgattgttccgcttgcggacactccggtttccgtgcgttgttcgagactgtcttctgcaagcggttcaacaggttccacctgtgcctgcgcctttagtcgtgcttccgcgagggcacgctccagttctttgagggcttcctgctctctcgctttggcatcggcagcgtcctctgcctgtaatttctgctgttccagttcacccaagaaggcaacttcgtcctggctgtactgtgattcgtatttttccttgtcatcatcgggttcgtctcgttctatgttatccacagccgtgtagtcggcaatcttgccccacgactttgccatgttctcgtatttgcttcctatgccgtcgccgcccttgatggtggcatcgggcaggtcgggattcaggaactccgtggtctggagtgtcttgtcggctatctctgccttttctgcattgaagaggtcaaagatgaaataggacgcgcccaacagcggaatatacaatatggcaggaagcatatatttgggctgcctgaaattgattttctcgaatatccttttcattgttgtctggtttgggtgggttcaacaatgggagcaaccggctccttgtggcgttctctgagcaggctgtcctgcatttctgtagcacttcttatctcctgaccatgccgataagctttggtcagccgataaatgttgaaggtgaatgtgccgattacgaaaccgaataccatgacaaggaacagtatcttgttcctgttggcaaagccctgtatcttggcggccagtttgtcaagacgtgtcgcctgggcgaatttgcgaccggcattcacatcacgctcgtatctctctttgtattgtggatcgttcttgtccggcatcttttcgccgaacagcatcctgcggaatcctttggtgttcatatctgtaaattttaataggttgctttcgttttctgttcgatgtctttattgaggagggtacgccaatttacgataagcagtccgtgcggattgttctcggttctcggtactcgtttaagttgccctgccgtcaccagttcacgcatcaggatattgcttctgcgctcgatacgctgccgtccgtaataagtgaactccatattgcttttgtcaaaccgcacactgtcgcagtaaatggagaatacggcactcgttcccaagatgttggagtaaaagcctttctctttgagcgtgttgtactgtgcaagtccggtctcgtccaccaggtacatcgccttttccatcgtgtatttgatgtacttgtcatcgggaggaagcgtgaaaaagaagtggtggaacatttccacatgacttttggcttccacatcaagggtttcgtccatcgtggtacggttgaccaatattggcacgttgccgtccagcacatagactttcttctgtgcatctgtcaccattgtccgtgccgtccaaatgctgcttacgctgatgatgatgcagccgacaaggaagaacgagcagatgattcccactaacttgattttgttttctaaatttctgattaccattgtatattcttgattatgagtttacgattatcgcatcatggtgccgattgcaccggtcgctgtcattttcgcctgttgagccacaccttcaccgaagtttcgggttgagaatgccgtgtcgccttctggaatcatccatgccgccaagtccggaacaaggttcaggcatttcaatgccacgatacttgcagccataaggtagcctgccgagaaaaaggagttttgcagataagcagccattgtctgctcacttaccgtgattgccgtcaggttttccacctgtatgcaaagcacaatgtcgaacagaagcaggacataaaatccgacgaagtagagcatcgcaccataaaaatgtaccgtcagataccttgtcagccatttggcccaagctccttcccatttgggcaagaggctgaaagcccattgtatcggtccgaaaatcgtgagcattccgagcaggatttgctggcagtaaatcgtagcccaccagcctatgcgaaatacaattaaagctatgagcatcacgattttatctattcctacaacaatcccggaagtaagtgaagtgaaccaaagtttggctgcatccttttccatattggtcacttcgtccaccccggtctgttccatagtggcttctatcagattagggtcggaagttccgctgtgtgccacatccgcctgtgcttgcaggctggtgtacatcgtatctcttgcatagatgagttgctgcacctcctgaaatttatcctctatctgtgtggcttctgcctggtacaggtcatgagtgtaagagccgatacagtttgggatataggataggaaatccaacacacaccagttgcttccgctgtttaccatacccgtgtcagccggaggataccaccagcataggataattgaaattgccaatggcttgaacaacttcatgatatccagcggttcattcttgaccatcatcttgtacgccatacctgctgccatgacgattgcaaacaaggccgcgagtgccatacacatctggagaatccaccaaaacgggccttgtgaacctgtgaaggtggcatccgtcaggaactcgttggtctgaaaaatcacatcatcaatctcttcttcaagcagattgatgccgaaatctgaaagtatatctccgcttgccatctatttttccatttaattttatctgttcacactctcattaccgtctccgtcttcgcttccgtcatcattctgcgaccctcgcactgctgaccgggattcgttccagcgactcatggcattgctgataatgcttcttttgtctatctggcggttctccgttgccgaaaggagattcttcgtggcattgcggttgctcaactggacgagatatttcaccagtacatcgttttgccgggagacatcggcatagatttgcagatactctttcttacgctgcgcattgggcatataggcatcccttgttgccttgattgcgcattgatagacacggtaatagtcgttccaccgttctttttcttttggcgagccgcctgtcatcattatgcggtcaatgttcttctgaaactgccgcatctgggattctatcttgtccttttccgcaagccaggccagatccacttgtcggtctgccacattcaaggcttcaatcttggctctgcttgtgagtgcggaatctatggcttccgcttcatctacctgctgataggaagccacgcctgccgccgtgcggaatgtgagtttgttcttgaccgctgccgttttcttgtatttgttgtgcagcaacgtgtaataaagttccggtttgagcgcaccggctccggtttcttccaccgtgatttggttcatcttgggcgaatcgtggttgtaggtgacatattgggcgtttgccgcaatggttgccacgaacagcatcgttgtaaaaatccatttcataatttctctatttttagttatcaataatcctgtttacctgattgtctccaccgtccgaaagcatcgtcaataagttcccgtttggttttggtacgatagactttctctttccaatagccgatacgaacctgtatgtaccgccaggtctcgaaataggcacggttcaaatgcttctcgatattgtcaagagaacagttgatgctgttcagcaccatcagcaagtccgaagtggaacaggccgccgcacctgtggcgtacagaaccaaatcgctcacggatttatataggtattctccttcctgggctatcatccgtatggctccggcattgatggataatatcagcgtgtccgccaactctatgtgctttcgcttgatgaccttctcactgaaatcttcaagcatcgccttgtagtcggatattctttcgctgacccctttgtaggtggaatgtacattcaatgccgtgcgcagggactggtacatcacgtcaattacatcgaaagctctggtgtacttgtccagatccacgttcagttccttataacccaccatttccttgcggctgtactcatgcaacagtttattgctgtgttccaaggtggagcgagccagcaagaggcttcgctgttgcttgtggtcattgatataggcttcaaccgtccccacatcaaaactccattgcgcatttgcggacaggggtgccagcagcattatcaacagtccgagtatatatgtcctgcctcttttcatcgcttgccctccttagtctttctgtttcgtgcgttttccatccaacggtcgtgacattcctccacaagggaaagtctgcgcccctgatcatcgtcaacgggtggcagaacatctttcagcacgtcaatgatactgcgcctgtagtgcatcatcttttccaatgataccaagtcggcgtaaatcttcgtgagccgggaatccacttcacgggctatctccagccggtcgcttgaccaaagcaggtgatacatatcgtttgttttcgtgtcctcctgcggtgcagtacgggcgtattcagtcgttatcttgcacttcggatattctttcgcgatttccgctatgcggtcattgaccagttttgtcttttccttgtcgctcatatcggggtcaagcgtaatcacttccaccacatgggtatccgaatactccgttgccaagtcccaggagatttgcaggatagccctgtgtatcttgatgccaaggaagtatttgggctttcgggcgattttcagtgtcgccttgaatgtgatgatgccgttgatattcgggattgtgccttttcggacataggtgtagccgttccaggaaccgttgtcctgccaggtgatattgtaagccgtcttgcagtcttgcatgatagccggtatccggtaatagtcatcggtctgcacatcgttgtcgcttttggcttcttcttttgcctgtgcgatttcctcttgcttctgctgccaggcggcaagttcaggtttcaacctgtctatctccgctttgttctcattgtatttctgacggagaggaacggcatcctccacactggcattggcaatctgtttgataagcgattcgttttccgtttccaatgcggatatttgtgactggagcgcgtaaaccttgttgtccgcttcccgctgcatggcatcgagttcagacaaatccagttcctcgctttcagctgtagtcttcatcgcgcactctttggaatgtgcgttgagcgtacttccgcatttccggcacttgtactgggttgttccctgcccaagtgtcgcaccgtccgaacaggtgacactgattgttaccgtttcgcatcctttcagtttctcttcattggttgcctggtaatagttccggctgtcggaagcgatataatagacatagccgtcttcgttgtcgttaaactcagacagatgtgcattaagttgtgccttgaatgtgttcaaatccatcgaataggaatcgaacacgtcttcatagactatttcctcgttgttccagcttttcgtgacatggatttcgtaggcgtatgccttcttggtctgcttctttccttttttaatgatatagctggactggtaataattgatggtgtaactgaagccgtcattggcgttgttaagctgttgcactctgttccttgaccatccggcgtagcgttccgaattggaaagggcctgttccttttgcgatgcgttgggatagaagttcggatagcttgtcttgaagcgggtccattcaccaccttcaaggatgctcttgtcatctgtcgggggataatagtcgcagagggagacactgccacggtcacgcctcgcgatgtaccatcgctgggtgtagtaattcccggctgtttcgtccaaataatcggtaatccacgaagtgaggttgtagtcgctgaacttgaacaatcctgccacattttcttcactacccacgatacccagtatggtctgtccggcattgttctccagttgctcgaaaagtccgttgtaatgctcgtagatgtcaatgaccttgctgaccttcccgttcatcagctcgtgaaacgagttctgttgcaacaaggcgttcccgatattggtgattcccgaagtggcaagaccggctcccatccggtaaagtttgtccaaatcggctttcaggttttccttggtgaagttgcccggtattttggatatgtcatcaaagagccgttgccagtccacgttgccaatctcggaaagttttaagatggaggcgatttcctcattgatttccagaaaggcgatatcggagaaagacagtgtgctgttggtgacaacgctctcgaactgcatacagagggatttggtgtcatcgcacactttcatcagataactgcaccaatggagtgcggtttgtggagaacggagcatcagcttggcgacaatccatgtcttcgggataatcttgtgcgccaccaagtgataaatcctgcggtagtagtaattttcggtggcactgctccagatgcccaaatcagtgagtgccttcctctccaggaacttgctggcaaatattccggcagtggccacttccgaagccttgtagtgtttcagtatattctgcacctgctcgtcataatacgcttctgcaacggttccagtaccgtaggcggcaaccatagcggcaacggttttcgcatcgaagttcacgctgtaatactgggcatgaacttgttgggcgaaaatcgtggctattgtcattattatgagagcgaatcgtttcattgttgttttgtctttggttgatgaagattcaataccttcccggcagcattcactttttgggcaaacggcagggacttgcttattccggaagcatcccagtcagcgcaataacgctcgatggcttccttgtggctgcattgcagttcagccttgtagagtttcaaggcttctttctcggcccgttccgtggtataggtcatgtaacactcatgcggttcctccacaccatacacaccgctggtagtgccacggcggataaagacctcacgaaagaacgaacgcccctctttattctccagccggttgatggtaaagattttcttgcagtccacgtctgtcagaccgagaatagccttgatggtatcaaagcgttcacggaacttgctttggtcaagcagcattaccacatcggagttgttgatgatagcctcctttacaatctcagacccgatgatgtcctgaatctcttgtgtgaccacgcccactgaagcccagaactttcgggcggtcttatgtaggctaagcacccagcgccttatcatatttctatggtaggtttccaaatgctgggaagaggatgttttcatgatgcaaaaataagaattttaacgcaatcccccaaggtttcagactgagcccactgtttccgttatgatccgaaaaacattggatccgaaaaataaaaaaagagataaatcttctgatttacctcttttttcgctcttcctcttggacttgaaccaaggaccctctgattaacagtcagatgctctaaccgactgagctaaggaagaatgtttttctcaattgcgatgcaaaagtactaggtttttttgaaatatgcaatatctttgcaaaaaaaatattaggaatggacaaaataataggattgggcaacgccctggtagacgtactcgcaaccctgaaggatgatactcttttggatgaaatgggtttacccaaaggaagcatgcagctcatcgatgacgctaagttacagcagattaacataaaattttcacagatgaaaacccacttggcaacaggcggatcggcaggaaatgccatcctcggactggcttgtttgggtgctggaacaggatttatcggaaaagtgggaaatgataattatggagaattttttcgtgaaaatctgcagaaaaataagattgaagacaaattattgacctcggaccgactaccttccggtgtggcatccacttttatttcaccggatggggagcgcactttcggaacctatctgggagcagccgcttctttgagagcggaagaactgacgctggatatgtttaaaggttacgcgtacctatttatagaaggctacctcgttcaggatcatgaaatgattcttcatgccattgaactggctaaggaagcaggtttgcagatttgtctggatatggctagttataatattgtggccaatgatctggagtttttctctttattaataaacaaatatgtcgacatcgtttttgcaaacgaagaagaagcgaaggcctttaccggcaaggagccggaggaagctttgggagtgattgccaagaaatgcagtattgctattgtaaaagtcggagcaagcggttcttatatccgcaaaggaacagaggaaataaaggtttcggccattccggttcagaaagtggtggatactactggtgcaggtgactatttcgcttccggattcttatatggattgacctgtggatactcgttggataaatgtgcaaaaataggttctattctctcgggaaatgttattcaggtaatcggaacaacgatgccacaggaacgctgggatgaaattaagttaaatattaacaggattctggcagaataacaaaggattaagctacttttacgactcatttagattaaaaagaggtatgaaaaaattgctgaacaggcgaatagctattgttgcagtagcggtgatagccacagttgctttctttagtttcaagagcggagacgaccgtaatttccagattgcaaagaatctggatatatttaacgcgattgtgaaagaactggatatgttctatgtagataccatcgatccgaataaaacgattcgggaaggaatcgataatatgctttacaccttggatccttatacggaatattatccggaagaagatcagagtgagttggaacagatgattaaaggatcattcggtggtataggttcttacattgcttataatacgaaactaaagcgttcgatgatttctgaacctttcgagggaacacctgctgccaaagccggactgaaagcgggagatatcctgatggagattgacggccaagaccttgccggtaagaataatgcggaagtcagccagatgttgcgtgggcaggcagggaccagctttaagttgaagattgagcgtccgaatgtgaaaggcggacgtacgccgatggagttcacaattgtgcgtgagtctattcagaatccggcaataccttatactgccgtattggataacaatataggttacatcggccttagtactttttccggcaatccttccaaagaatttaagaaagcgtttttggatttgaagaaacagggagccacttcattggtgatagaccttcgtagtaatggcggtggattgttggatgaagcagtagaaattgcgaattatttcttgccgcgtggaaaagtgattgtgacgaccaaaggaaaaatcaaacaggccagtaacatttataaaacgttgcgtgaaccgttggatttggatattccgattgccgtactggtaaatagcggaacggcttctgcttctgaaatcttatcaggttctttgcaggatctcgaccgtgctgtgatcgttggtaaccgtacttttggaaaaggactggtacaggttccccgttctttaccttatggcggaacgatgaaagtgactacctccaaatattatatcccgagtggccgttgcgtgcaggctattgattacaagcatcgtaatgaagacggaagtgtcggcactattcccgacagtttaactaaggtattctatacagctgccggacgtgaagtccgtgacggaggtggtgtaatgccggatattacgatcaaacaagagaaattaccgaatatccttttctatttggtacgtgataatctgatcttcgattatgcaacgcagtattgtttgaaacatcccactatcgttgctccggagaagtttgaggtgacagatgctgattataacgattttaaagcattggtgaagaaagccgacttcaagtatgaccaacagagtgagaaaattctgaaaacgttgaaagaagctgccgagtttgaaggatatatggatgacgcttcagaggaattcaaagcgctagagaagaagttgaaccataatctcgaccgtgacttggattatttctctaccgacataaagaaaatgattgctactgaaattatcaaacgttactattatcaacgtggtaatatcatccagcagttgaaggatgatgacggtttgaaggaagcgatgaaaatactgaatgatccggtgaaatacaaagaaatgcttagtgccccggttgctaagaaataaagaaatatttttcaaatatagataatacagaaaacgcggctttgtcatcgacaggccgcgttttctgtatctaattgtaaatagtcatataagtgtcatcctcggatacaggtatttgtaacctcgactgacacatttattggcgaatcaaagggagagtgaaatagaacctgcttccctgcccctcctgggagcgcagccagatacgtcctcccattttttctactaacattctgcaaagagtcagccccaatccggttccctgaacaaaatcgttgacctttccaaagcggcggaaaatagtggcaactctttctgccggaataccgatgccgctatctttcacgtagaactctacaaaatcctctttttcccgatacccgaaatggatttctcctttgggggtaaacttcgtggcgttactaagcaagttacttataatttgtataatacgattccagtcaccggaggcatacatgtccgcatctacatcatctaaaataagtttgactccgttttgcgtcttatggcaaaattgttgctccagttgcagacagatatctgttaacttgatcggacagatgttgaattttaaagagtcggcctccagtgaggccaaatccagaatatcgttgaatagattcagtaacatttccgaattccgttcgatgatttccgcatattgattcttctcttccgtagatgttgcgaaagtgattagtttggagaatccgacaatcgcattgagcggagtgcgtatttcatggctcatgtttgcaagaaaagcagacttcagccggtccgactcttctgccttgactctggcggccttcagctctttctgttgttgcgcgttcgtctgttctgcctcccattgttgggatatatcacggcacatacacaacagatattcattatccaaaggaaagatgcggttttcgtagtgatgtaaaacaccgtccaacatcaggtcatgtctggctgtggaactttctcccgtgaggatcactttatccatattcttgcggacactctcataagcttcttccggcagaatatcttttacgttagtggtggtgatattattggcattgataccttctacgtggttggttgccggcgaagaagcaagctctataatattggcatcatggtcgaagacggtgagcatatcggggagggcatccaatatccgggtgctgtatttatcgcgaaaacgttcttgggaaggaggcgaaagatgagaggaaagaaaatttatcttctcttctaattgttcgattatttctaaaagttcctccttcgttttgccctcgtaatgtctcatagaagatttattgttattcattagaatattgtagaatttgttttatctgttgcaaatataagacaatattccgagacgcggattgcctcccaagttattataatataaaaaaaacggatagcttttgccctactaatcagaatgttctatctttgcatccattatatataaatgatttacaatatgtctacagaattattctctactctgccctataaggtggcagatattacgcttgctgatttcggacgcaaggaaatcgatttggcagaaaaagaaatgcccggcctgatggctcttcgcgaaaagtatggagaatccaaaccgttaaaaggtgcccgcattatgggatcgttgcacatgaccattcagacggctgtgctgattgaaacgttagtggctttaggagctgaagtacgttggtgctcttgtaatatatattcaacgcaggatcatgcggcggctgcaattgctgctacgggtgtgcctgtgtttgcatggaagggggagactcttgctgattattggtggtgtacattgcaagcattgagctttgcaggtggtaaaggaccgaatgtgattgtagatgatggcggtgacgctacgatgatgattcacgtaggttatgatgcagagaataatgctgccgtattggataaagaagtacatgcagaggacgaaatagaactgaatgcaatcttgaagaaagtgttggcggaagacagtactcgctggcatcgtgtagcggaagaaatgcgtggcgtgtctgaagaaactacgacaggcgtacaccgtttgtatcagatgcaggaagaaggcaaactgttgttcccggcattcaatgtgaatgattcggtcacaaaatctaagtttgacaacctgtatggctgccgcgaatcgctggctgacggtatcaagcgtgcaacggatgtgatgattgccggaaaagtggtggtagtatgtggttatggtgatgtgggtaaaggctgttctcattctatgcgttcttacggagcgcgggtactcgtgacggaagtagatccgatctgtgcattgcaggctgccatggaaggctttgaagtggtgactatggaagaagcttgcatggaaggcaatatttttgtgactactacaggtaatatcgatattatccgtatcgaccacatggagaaaatgaaagatcagtctatcgtttgcaacatcggtcatttcgataatgaaattcaggtagatgccttgaaacattatccgggtatcaaatgtgtgaacatcaaaccacaagtagaccgttattatttcccggatggtcacagcatcattctgcttgctgacggtcgtttggtaaatctgggatgtgcaaccggtcatccgtcatttgtgatgagtaattcatttactaatcagacattggcgcagatagaactgttcaacaagaaatatgatatcaatgtatatcgcttgccgaagcatctggacgaagaagttgcccgcctgcatcttgaaaagatcggcgtgaaactgactaagttgactcctgaacaggctgcctatattggtgtgtcagtggacggaccttataaagcagatcattatagatactaattagatttacgatttgacgatttactatttacgattgataaatgtgggagatcggtattctaccgttatcaattgtaaatattggattgtcagatcgtaatttattttatattcaaacttcaatcgtaaatagtaaatcgtgtcattgtaaatgaaaaagtttcttcccgacttaatagctattctggcttttatcattctttctttcgcctattttttcccggctgatattgaaggtcgtatcttgtttcagcatgacacggctgccggagtcggcgcgggacaagaatcgaaagagtatctcgaacgtaccggagaacgtacgcgctggacgaattcgatttttggaggtatgcctacctatcagatgtctccgagttacgactcgacaacgtccctgaaaggggtggagaaggtttatcgcctctttctcccggattatgtagtgctgacttttattatgatgctcggattctatatccttttgcgggccttcggaatatcagcctggctggcaggattgggcggagtgatatgggcattttcttcctatttcttcattctgataccggcagggcacatttggaagtttgtgacgttggcttatattccacctacgattgcgggtgtcgttctggcttaccggaagaaatacttgttgggtggaattattacagcactgttcatcgcccttcagattcagtcgaatcacattcagatgagctattatttcatgtttgtgatcctgttcttcgtgggagcgtactttgaagatgcttataaaaagaaagaactgccccatttcttcaaggccagcgcaattttggtattggctgccgtggtaggagtttgcatcaatatctccaatctgtatcatacttatgaatatagtaaggagacgatgcgcggcaagagcgaattgaagcaggagggcgctgcggccagccaggcaagtagcgggttggaccgtgactacataaccaactggagttatggtatcggcgagacattgacgttgctggttccgaacgtaaaaggaggaggatcagggtctacgatgtcgcaaagcgaagttgctatggcaaaggccaatccaatgtatagtggtatttattcgcagttgccgcaatatttcggtgagcaaccgtggacagccggtcctgtatatgtcggggcatttgtgatgttcctgttcgtattgggttgtttcatagtgaaaggtcctctgaaatgggcattgctaggagctactatcttctcgattctgctttcatggggaaagaatttcatgggattgacggacttctttatcgattacgtcccgatgtacaataagttccgtgctgtatcttccattctggtgattgctgaatttaccattcctttgttggcgatttttgctttgaaagagattttgagcaaaccggatacgctgaagttgaaagagaaccgtggaggggtgattgccactttggtactgactgctggtgttgcgttgattttagctgttgctccgggtgctttcttctccggttttattacgacacaagagatggctgctttgaaacaagcacttccagccgaacatttggctccgtttgtggcaaacctgactgaaatgcgtgaagctattattgcttcggacgcatggcgtagtttctttattataatgattggttgcctgtttttattcttatatcaacagcggaagttgaaagcttctttcacattggctggtattgcgcttttatgtttgatagatatgtggagcattaataaacgctatttgaatgacgaacagtttgtgccgaaatccaaacagacagaagcgtttgttaaaacacagacggatgagatgatccttcaggatactactttaaattatcgtgtgttgaactttataggcttccccggtaatacgtttaatgaaaacaacacggcatactggcataagagtgtcggtggttatcatgcagcgaagctccgtcgctatcaggaaatgatcgatcatcatatcatgcccgaaatgcaggaaacctatcaggcggtggctactgccggcggacagatggacagtgtagacgcttccaaattccgtgtactgaatatgctgaatacaaaatacttcattttccctgccggcgagcaagggcaggctgttcctgtggtaaatccttatgcatacggcaatgcatggttcgtagataaggtgcagtatgtaaataatgcaaatgaagaaatcgacgctttgaatgatattcttccaacggaaacagccgtagtggatgtgaagtttaaagaacaattgaaaggtgtgacagaaggatataaagattctctatctaccatccagttgactagttacgagccgaatcgtttggtctacaaggcttccactcctaaagacggagttgttgtcttctccgaaatatattatccgggatggcaggcgactattgacggtcagctcgtcgatattgcccgtgcagattatatcttgcgtgcgataaatgtaccggcaggggaacataccatcgaaatgtggtttgatccacaaagcatacaggttacagaaagtattgcttatgcggcactgactttgttgttgatcggagttatggttcttgcgtggacgcagcggaacaagattgcgaagaagtcttaagcgaaatgtaatagtcattaaccttcataatgtatggtaaggttataaaataagggcggcactcctcctcacaaagagcgccgcccttattttacattcactaaaaaaatacgaaaaacaaacactgttcatagaaacatattaagtgtgatgttttatgagagtagttgtttattgtttgttcattgaaaaaggaaaatatgaatataaacaaatagtttgtggatagtcttattatgctgtaagctactaaatttgtagccaataatagagcattatgttatgaaaagactactattcattttttccttttttttcttgttcgtgttacgtgggaacacacaggaggtagagattctgacattagaggattgtctccgcattggtattgacaataacttgtcgttagaagggaaacgtaaagaaatacaaaaaagtaaatatggcgtatctgaaaaccgttcgaagctgctgccgcaaattaatgcgatagccggttataataacaattttgatcctccggtgtcagtcacagacggttcatcttacggagttccctataatataacgaaaacattgcaacattctgctaatgcaggactggaaatgcagatgccgcttttcaatcagactctttatacttctatgtccatagctaaagtgatggaagaaatcagtcgtctgtcttatggaaaagccagggaagatgttattcttcaaatcagtaagatgtattatctcggacaggtcacggccgaacaaatcatgctgataaaagcaaatatcacccgtctggaagaattgagagatattacacaggctttcttcgataatggaatgtctatggaagtcgatctgaaaagagtcaatatcaatttggaaaatctgaaggtgcaatatgacaatgcacaagcaatgatgaaacagcaattgaatatgctgaaatacattatggattatccggctgaaaaggaaatcgcgttgacaccggtaaataccgatagcattactacggtagccctgaccggcttgtcggaaaatatctatgaacttcaactctcacaatcgcaagtgcaactggcggaacggcaaaagaagatcattgctaatggatatatcccttctcttagtctgacaggcagctggcgatatgctgcatatacggataaaggttatcattggttccactccggtccgtccaatcaatggtttcgttcctatggagtggggctaaccttgcgtattccgattttcgacggactggataaaacctataaaataaagaaggcgatgatcgatatagagaacaaaagactggcatgggaagatgcccggaagaatctgcaaactcaatatctgaatgctgtgaacgacctgatgaacaatcagcgtaactttaagaaacagaaggataactacttgcttgccgaagatgtgtacgcagtcacttccgaccgttaccgggaaggcattgcttctatgacggaagtgctgcaagatgaaatgcagatgagtgaagctcaaaacaactatatcagcgcacattataactatcgggtgactaacctgatgctgcttaaactgaccggacaaatagaatcattagtcaaataatacgcaaataacaatcataaatatggaaacaatggaaaataaccttccttccgctactcatcaggagaaagcaaaaaaaatgaagaaacttcgtcgctggcagattgctatcagccttctcggagtggctattattgtttggggagtgattgaagtgatctgcctttttttgaattatagccagacggagactagtaacgatgcacaaatagaacaatatgtgtctcctatcaatctacgtgcttcaggttacattgacaaaatctactttacagaacatcaggaggtacataaaggagatactttactggtactggatgatcgtgaatataaaattcgcgtaatggaggctgaagctgccttgaaagatgcgcaagccggtgcgaccgtcatcaatgctacactcaatactacgcagacaacagcatctgtttacgatgcgtctattgccgagattgaagtacgtttggcgaaactggaaaaagaccggaaacgatatgagaacctcgtgaaacgaaatgcggctactcctatccaacttgaacagattgtcactgattatgaagctacgcgtaagaagctggaagctacgaaaaggcagaaaaaagcagctctttccggtgtagatgaagtgtcctaccgtcgcatgaataccgaagcggctattcaaagagcaacagctgcgctcgaaatggcccggttgaatctttcctatacggttgtaatagctccttgtgacggaaaactcggccgtcgctcattagaggaaggacagtttatttcggcagggcagaccatcacctatattcttcctgatacccagaaatggatcgttgccaattataaggagacacaaatcgagaacctgcatatcggacaggaagtatttgtcacagtagatgccattagcgataaagagtttaaaggcaaagtcacctctatatcaggagctaccggctccaaatattcattagtgccgaccgataactccgcaggcaactttgtgaagatccaacagcgcatccccgtacgcatcgactttaccgatttatcaaaagaagacaacgaacgattagcagcaggcatgatggtagtagtgaaagccaaactctaaccaccgtgcacctataattcataaatcataattcataaatcaaaaattaatgccctcttatcccaaaaattatcctttctatagctggatgcccaaaccgttgggtattatcattctgttatttttctttctgccgattcttacggtaggcggggtttattcggtgaatagcaccgaaatgatgagcgggcttggcattatatccgagcatatccagtttgccaactttgttacttctattggtatggcagcctttgctcctttcctatatcagttggtgtgtgtgcggcgggagaagatgatgtgtattgtcgggtttgcgttcatgtatatattcagttatatctgtgcaaagacagacagcgtttttctgttggcgctttgtagtcttctgacgggtttcttgcgtatggtactgatgatggtcaatctgttcacactcatttggtatgcgggtggaatggaagctacccgcaatattactccggggttggagccgaaagatactgccggttggaataaattggacattgaaagatgtgtgagtcagccggctgtttatctgttttttatgattctaggacagtcgggcacagcattgacggcttggctgtcctttgaatatgagtggaaatatgtgtattgctttatgatggggattctcctgatctctattttgctcttgtttattaccatgccgaattataagtttcccggaaggtttcctattaatttccgtaagttcggcaatgtcactgcattttgcatctcgctgacttgtctcacgtatgtgctggtttatggaaaagtactcgactggtatgatgacgaatctatccgttgggcgacagctgtaagtattctttttgcgggaatttttctatatatggacgtaacgcgccggtcgccttatgttttgctggatgcgttcaaactgcgtactatacgtatgggagcattactttacttattattgatggtgataaactccagtgctatgtttgtcaatgtgtttgcaggagtggggatgcatctcgataatctgcaaaatgcttcattaggtaattggtgtatggtaggttatgctattggcgccgtgattgctatggtgttgggaggtaaagggttacattttaagtatctgtttgcgatgggattcttcttcctgtctttatcagctgtttttatgtatttcgaggtgcagacagcaggagtttacgagcgtctgaaatatgcagttatcatccgtgccacaggcatgatgattctgtatgcgctgacggctgcttatgccaatcaacgtatgccttttaaatatctttccacctggatctgtattatgcttactgtgcgtatggttgtgggaccgagtatcggcggagcaatttatacaaatgttttgcaggagcggcagcaacactatataacccgttatgcgcaaaatgtggacctgcttaatccggatgcttccacttccttccttggtacggtacaaggtatgaaatatcagggaaagagtgagacggaagcccgtaacatggctgctatatctaccaaagggcgtattcaggtgcaggccacgctctctgcactcaaagagatggcgggatggacaatttatggtgggttaatttgtatgatatttgtgctcgttgttccttatcctaaacgaaaattgctaacttagcgtcgtttttgataatgatctgttaatatattagtatgatggatagcggacaagatcgtttattgcagtttgaacgcgatttgttaagtgggaaaaatatatgtagctccgaagggatatttgtaaattttccaccctcactgaagaaaccttttcaaatgaaaggactggggctgattatttgccgccagggtaatttccagttttcgcttaatcagaaaaagcatttcgcaggagcaggcgaaagtttgtttattcccgaagacggcgagtttcaggttttgcaagagtcggaagacatggaggtacggattttgatttatcagatagaaccgatccgggatattatggggaatctggttgtttccatgtatatgtattcccgccttactcccgaagaaccttcttgtgtctggtctactggtgaggaagaagagatcgtaaagtatatgtccttattggacaatgtgttacagtcggaagaaaattcatttaaactttatgagcagaaattacttctacttgcattgacgtacaggatctgctctatttataatcgcaaactcgtcaatgacgggcgggaagtgggaggacgcaaaaacgaagtctttattcacttgatccagttaatcgaaaaatattatatgcaggaacggggtgttgagttttatgcggataaattgtgtttgtctcctaaatatctttctgccgtttctaaaagtatctgcggatataccgtgcaggaacttgtattcaaagctatcattcgtaagagcatctcattgcttaaaaatacgcagaaagatattcaggagatttcaaatgctttcggcttccccaatgcttcttatttcggtacgttctttaagaagcaggttggggtttcaccgcagcaatatcggaagaatctttaaacgtttattctttttcaccgtaggcaagatcgcccgcatcgcccagtcccggaacaatgtaagaatgttcgttgagttcgggatcgatggctgcgcaccagattgttgtcttgtctttcggaaatacattctttatatgatcgatagccttttggctggcgataatcgaagcaacatgaatttcagcagggtgtcctttcgtcagcattgcctggtaactaagttccatactccccccagttgccagcataggatcggtgataatcagcgttttgtcatcaatgcggggagaagcgatatattctatatgtatatcgaattttagcgtatctttatatttgcggtaagcggaaacaaacgcattctccgccctgtcgaaatagctaaggaaaccttgatggaaaggcagaccagcacgcaggatcgtactgattactaaattgttgtccggtgtactgaccggagcgattcccagtggtgtctggatgttctttaccgagtatttaaactctttactcatttcataagccatgatttctccgatccgttcgatgttacggcggaaacgcaggcggtcgttctgaacttctacatttctaatttcggatatgtactggtttagaatcgaattagtttggccaaaatcaattactttcatattatattttaatcaaattttaatctcattttcatagtattgataacatactggcttgcaaagtaaacgataatctttcaaattgcaatattcagtttgcagatattgttaggaatttataaaagagtttcaattagggaaaaatttctctaataccttcttcctttccaaagaaagtattacttttgtagccggatttacaagggggtatccaaagctccccatgttaaggtgaaaagagatagaaaacaaaataccaattttaattaattcaaagaaaatggcaaatttagatttaagcaagtacggcatcacaggtgtgactgagattttgcacaatccgtcttatgatgttttgttcgctgaggaaacaaaaccgagtctggaaggctttgaaaaaggtcaagttactgaattaggcgctgtgaatgtaatgacaggtatctacaccggtcgttctcctaaagataaattcttcgttaagaatgaagcttctgctgattctgtatggtggacttccgaagaatataaaaacgataacaaaccatgtactgaagaagcttgggctgacttgaaagctaaagctgtaaaacaactttccggcaaacgtttgttcgttgttgatactttctgtggtgctaacgaagctactcgtatgaaagtacgtttcatcatggaagtagcttggcaggctcatttcgtaactaacatgttcattcgcccgactgctgaagaacttgctaactacggagaacctgatttcgtatgtttcaacgcttctaaagcaaaagttgacaactacaaagaactgggcttgaactctgaaactgctacagtattcaacctgaagactaaagaacaagtaatcctgaatacttggtacggtggtgaaatgaagaaaggtatgttctctatcatgaactacatgaacccgcttcgtggtatcgcttctatgcactgctctgctaacactgatatggaaggaactagctctgctatcttcttcggattgtctggtacaggtaagactactttgtctactgacccgaaacgtaaattgatcggtgacgacgaacacggatgggataacgaaggtgtattcaactacgaaggtggttgctacgctaaggttatcaacttggataaagaaagcgaaccagatatctacaatgctatcaaacgtgacgctttacttgaaaacgtaactgttgacgctaacggtaagattgatttcactgacaagagcgtgactgaaaacactcgtgtttcttatcctatctatcacatcgaaaacatcgttaaaccggtttctaaaggtcctcacgcaaaacaagttatcttcttgtcggctgatgcgttcggtgtattgcctccagtatctatcctgaacccggaacaggctcaatactacttcttgtctggatttacagctaaattggctggtacggaacgtggtatcactgaaccgactccgacattctcggcttgtttcggtgctgctttcttgtcattgcacccaactaaatatgcagaagaactggttaagaagatggagatgactggtgctaaagcatacttggttaacactggatggaatggttctggtaaacgtatctctatcaaagatactcgtggtattatcgacgctatccttgacggttctatcgacaaagctcctactaaggttattcctttcttcgactttgttgttcctacagaacttccgggtgttgatccgaagatccttgacccacgcgacacttacgaatgtgcttgccaatgggaagaaaaagctaaagatttggctggacgtttcatcaagaacttcgctaaatttactggtaacgaagctggtaaggctttggttgctgctggtccgaaactctaattggagaatcagatataatatggaaggcggttcgatttcgaaccgccttttttattgctatactgtgtctttctatgaaaaggaatactgtctgtttagttttttttcctatatttgtcaaaacgagactatttacttttaaagacagctatgacgtatctggatacagacaaacagacctatgcggatttaagcataacggagactgcaaacaatgagcagtttcttttctctttgttttctaaaacagagacgaaagaaggaaaatcattgatgatgaactgggttatgtatccgctaagtgatttggatatgatccgcaaaaggcaggaggctgttgcgtgggatgctttacctgaacttcttttgaatgaagaagaactggattttattgaatattatctggcttatcgcgaccagatcagggaagcacacgtcttactgtcatgtgctactgtcatagatcgcctgttgagatatgattcaacccgttatgttatttgtcggggagtgaaattggtaatacatttgctgcattgtttggagaggtgggcgaaagaattggatgaggatgccccacaattgatgaaggagtcagcccgtatggtgaatgatattttgtccggaagtgaattaggtgaagtcttggaacagacttctggcgaagaaaggcggctatctaattatacgatagataaatacgattatctatttcgatgtacccgtttgttgtctttgaaagaattattatcagttttgtatttattggatgtctgtcggacagctcaccgggtagcgagagagaaaaatttctgttgtacaccgaaagtggtggaaacaatggatttttcggttgagggtgtagttcatccttttgtgaaaaatgtacgggagaatagctgggtgatgtctcggggaaatatcagtatttttacgggttctaacatggcgggaaagtcaaccactttaaaagcactgactttggctgtctggctggcgcattgtggactgcctgtcccggtgaagtcaatggtttgtcctctttacgaaggtatttatacttctattaatttgccggactctttgcgtgacgggcgaagccatttcatggcagaggttcttcgtataaaagaagtgatgcaaaaagcgcttacaggaaaacgttgtttggtcgttttggatgaaatgtttcgcggaactaacgctaaggatgcttttgaggcttctcttgcagtcaatgaattattgaaaagattctcttgttgccatttccttatatcaactcatattctggagtatgcgaaagcatttgaaaaagatcctgcctgttgtttttattatatggaagcggaaattattgacgatgcatttgtttgtcatcatcggctattgcaggggatttcggaggctagggtaggatattgggtcgtgaaaaaactactggccggtttgatatagtttcaccttattattgtgtccattaagacagtattttatttttattaaaggcatattttgattacttttgtacaaaccatatacgagagaataatcttgaataataatgcgacaaccatgaagaaactctatttctttcttatctgctctttgtttcttgtctccggactttacgcgggtgaaactgattataccaaaggactttccatctggtttgatactcccaatactttgcaggggtatgccgtgtggtatgggggaagaccggatctgtggaaaggtggtgataaaccggaaacagcaggaaatgcaggtcataatccggatcccgcttgggaatcgcaatcattaccgatagggaatggtagtttaggtgcgaatatcatggggtcggtggaagctgaacgtattacctttaacgaaaaaacgctttggcgtggcggtccgaatacagcgaaaggggcggactattattggaatgtcaataaacagtcggctcatcttttggatgaaatacgtaaggcatttacggaaggaaatcaggaaaaggctgaaatgctgacacgtcaaaacttcaacagtgaggtgtcttatgatgctgacggagaaacacctttccgtttcggcagttttactaccatgggagagttttatgtagaaacgggattgaatattatagggatgagtgactataaacgtatcctttctttggactctgcaatggcagttgttcagtttaaaaaggatcatgtggtttatcagcgcaattatttcatttcttatcctgccaatgtgatggtgatgcgtttcagtgcggatcaaccgggtaaacaaaacttggttttcagttatgcgcctaatccggtgtctaccgggaatatggcttctgacagtaataaaggactggtgtattccgcatctctggacaataacggaatgaaatatgtcgttcgtattcaggcggagacaaaaggcggaaccttgtctaatgcagatggaaaactgatggtgaaaggtgcggatgaagttgtgttttatattacggctgatactgattataaacctgactttgatccggattttaaagatccgaagacgtatgtgggtgtcaatccggaagaaacaaccaaggaatggatgaataacgcagtgtcacaggggtatactgctttgtttagtcagcattacaatgattatgctgctttgttcgatcgggttaaattgaatctgaatccggcgatcaagggaagaaatctgccgactccccagcgcttgaaaaactaccgggcaggacagccggattatgatctggaagaattatattttcaattcggtcgctatctgttgatttcaagttcccgtccaggcaatatgccggcgaatttgcagggtatctggcataataatgtcgatggaccgtggcgtgtggactatcataataatatcaatattcagatgaattattggccggcctgctccactaacctaaatgaatgtatgcttccattggtcgatttcattcgtacgctggtaaaaccgggcgaaaagaccgcgaaatcttattttggtgccagaggatggacggcatccatttccggaaatatattcggatttaccactccgttggaaagtcaggatatgtcgtggaacttcaatcctatggcaggtccctggttggctactcatatctgggagtattatgattatacaagagatcttacattcctgaaagaaacgggttatgagttgataaaaagtagtgcggactttgctgtcgattatttgtggcataaaccggatggaacatatacggctgctccatctacttcgccggagcatgggcctatcgatcagggtgctacctttgtgcatgccgttgtacgtgagattttgctggatgcaatcgaggcgagcaaagtgttgggcgtagataagaaagaacgtaagcagtgggagcatgtgcttgccaatctcgttccttataaaatagggcggtatggtcagttgatggaatggtcggtagatattgatgatccgaaagacgagcatcgccatgtgaatcatttgttcggactgcatccggggcatacggtttctccggtcaccactcccgaactggcgaaagctgctaaagtagtactggtgcatcgtggtgacggggctactggttggagcatgggctggaagttgaatcaatgggcgcgtttgcaagatggtaatcatgcttataccttgtttggcaatttgttgaagaacggcacgctggataatttatgggatacacattcgcctttccagattgacggaaactttggcggaacagccggtattaccgagatgttgcttcaaagtcatataggctttattcagttgctgcctgctttgccggatgcatggaagggtggggctgtcagtggtatctgtgcaaaggtgaagtggatatggtttgggagaataatcagctgaaagaagctgtggttcattctaatgcgggaggaaactgtgtgataaagtatgctgataagactctttcttttaaaacggtgaaagggcgtagttaccggattgaatatgatgtgactaaaggacttattagacagtaaatagaaaatatcggaaaattagaaagtaggaatggtattagagtatttgaaattgttcgtgacgtttgcgaagattggaatgtttactattggtggcggttatgccatgattccgttaattgaacgggagatagttgccaaacagtggatgagtaaggaagaattcatggagatgtttgccttgacgcagtcactaccgggtgtgtttgctgtgaatatttctatttttgtaggatataagttgtataaagtgggtgggagcttggtatgtgctttggctacgattcttccctcctttgttattatgatgctgatagccatgttttttgcacggtttcaagataatgaagtgatgattcgcatctttaatggaatacgtcctgccgtggtagcgttgattttgtttccttgtatttctgctgtaagagctctgaaactgaaataccttcagttggttgctcctgccatagctactcttttgatttggcagtttggactgtctcctatttatattgtattggcaggaattctgggaggattggtatatacattgtggttgaaagaaaaaataatgaataaagaggtatgatatatttgcaattactttgggtgtatcttaaaataggtatgttcggttttggaggtggatatgcgatgctttcccttattcaacatgagatagtggatattcatcattggctgactccccagcagtttacggatgtggtggcgatttcgcaaatgactccggggccgattggtatcaatagtgctacttatgtagggtatgcggtaacgcaaagcgtgtggggagcggtgctagctacggtagcggtttgtttaccttcttttattctggtgttgctcatttcttatttctttgcgaagtgtaaggataacaagtatattaaggcggctatgtccggactgctacctatgtcggttgctttgattgcttcggctgcattgcttatgatgaatagagaaaattttatggactataaaagtatcggtatttttgcggcagcctttttggttacatggaaatggaatcttcaccctatcctgttgatttgtctggcgggtgtggtaggattgttgttgtattagtaatgcttgtgatacttacagaaaaaaataaaatcccggtaaaacactgcgtttcaccaggatttctattataatataatgaaagaatggttagttcttgttggcacgtttacgttcgatttcgtccaaaatcactttacgcatacgcattgcctttggagtaacttctacatattcgtcttccttaatatattccaatgcttcttcaagtgagaactggataggcggaatcagacgtactttgtcatccgaaccggaagcacgcatattcgtcagcttcttcgatttggttacgttgataaccaagtcgttgtcgtgagagtgctcgcctactacctgtcctgcatagacttcgtcctgcgggaaaataaagaacttaccgcgatcctgtaatttgtcgatggcgtaagcaaaagctgttccgctttccatagcaatcatagaaccattggtacgacgttcaatttctcctttgtgcggctgatattctttgaaacggtgtgccataatggcttcaccggcagaggccgtcagtacattggtacgcaaaccgatgataccgcgtgaaggcatattgaattcaagattgatgcgttcgcctgtattttccatctttaccatttcacctttacggcgggtaaccatatcaataattttgctggaatattcttccggtacgttgatggtcaactcttcaatcggttcgcatttcacaccgtcgatttctctgaagataacctgtggctgacctacctgcaattcatatccttcgcgacgcattgtttcaatcaatacagaaaggtggagtacaccacggccggaaacaatccatttaccgtcttcttcactctttcttacgcggagggccaggttcttgtcgagttccttcatcagacggtcgtggatgtggcgtgaagtcacaaacttaccatccttaccgaagaaaggagaatcgttgatagcaaacaacatactcatggtcggttcgtcaattgcgatgggtggcagtgcttccggactttcgaaatcacaaactgtatctccaatctcgaatccgtcaatacctaccagcgcgcagatgtcaccggaagaaacctcatttgttttcacacggcctaaaccttcgaaaacatggagttctttaattttgctcttgaacatatcgccgttacgtttcacaagcgttatattcataccttcttttaatgtaccacgatgtacgcgacctacggcaatacgaccggtataagaagaataatccagagaagtaatcaacatctggggagtaccttccaactgttgcggtgccggaatgttttcgacgatacaatccagtagcggagtgatgctgtcagtttgttgttgccagtcggtgctcatccagttgtttttggcggaaccgtaaatcacggggaagtccaactgatcttccgttgcgttcaagctgaacatcaagtcgaaaaccatctcgtaaacttcttccgggcggcagttaggtttatctaccttattaactaccacaatgggtttcaaaccgatttcgagcgccttttgcagtacgaaacgagtctggggcatcggaccttcgaaggcatctaccaacagaatacagccatcggccatattcaatacacgttctacctcaccaccgaagtcgctgtgtcccggagtatcaataatattaatttttgtaccgttgtaattgatggatacgtttttggagagaatcgttataccacgttcacgttccaaatcgttgttatccaggataagttcaccactattttggttgctgcggaataaatttccggccaatagcatcttgtcaaccagcgttgttttcccatggtcaacatgggcaatgattgcaatgtttcgaatattttgcatataatacctattatttggctgcaaaggtacgaaaataggattagaaatatgcgcaatgatagcaattttttcttgtaaatcgttgtgtgatataaagataatgcctatctttgcacgctcaaaagaataaattatcaattaaaattctaagaattatgtatttagacgctgctaaaaagcaagaaatcttcggaaagtacggaaagtctaacactgacaccggctcagctgaggcccaagtggcattgttttcctaccgtatttctcacctgactgagcacatgaagctcaacagaaaagattatagtactgaaagagcgttaacaatgttggtaggtaagcgtcgtcgcttactcgactacctgaaagcaagagatatcgaaagatatcgtgctattgttaaagagctaggtttgcgtaagtaatctacttgtcgcgaaaagatttaaagccgttcctcatgatagaggagcggctttttttagtttcttctttttcttcctgatagtcgtattttcttcggttataattgtgttcatctaaagattttgctatttttgcagcttaattattataatttatcacctttgataactaaaatgctttcaaaatggatacaagtaagattgttggcgagaaaattaaagccctccgcgaagataaatcaataagcatagaagagttggcgcaacgttcaggtttggctatcgaacaggttgaacgtattgagaataacattgatataccttctctcgcaccgctgattaagattgcgcgtgtgttgggagtacgtctgggtactttccttgatgatcaggatgaagtcggaccggtcgtatgccgtaagaaagaagccaaagatgcgatcagtttttccaataatgcgattcactctcgcaaacacatggaatatcactcgttgtccaagtcaaaggcggaccgtcacatggaaccgtttattatcgatgtgatgccgacgcaagataccgacttcgtgctttcttctcatgaaggagaagagtttatcatggttatggaaggtatcatggaaatcagctatggcaagaacacctatctgctggaagagggtgatagcatttattatgattccattgttcctcatcatgtacatgcttatgagggacaggctgcaaaaatcctggcagtagtttacacaccgatttaatgaaatagtaggaaccaagacttaagtataattacatgcaattatttgatcgtactttggggcagtggctggagcactgggctgaagagactcccgataaggaatatatcgtatattccgaccgaaatctccgttttacctggagtcagttgaaccgtcgtgtggatgatatggcaaaagggcttattgccattggtgtggaacgtggtactcatgtgggtatctgggcggctaatgttcccgattggttgacattgctatatgcctgcgcgaagattggtgcggtatatgttacagtgaatacgaactacaagcaatcggagttggagtatctttgccagaactcggatatgcatacactttgtattgtgaatggtgagaaggatagtgattttgtgcaaatgacatacacgatgcttcctgaattgaagacttgtgagcgtggacatttgaagagcgaacgctttccatatatgagaaatgtagtatatgtaggtcaggaaaaacatcgtggtatgtataatacagcggagattctgctgttgggagataatgtggaagatggccgtttgaacgaactaaaaagcaaagtggattgtcacgatgtagtaaatatgcaatatacctcgggcactaccggtttcccgaaaggggtgatgttgacacattataatatcaccaataatggatttctgactggtgaacacatgaagttcacggcagatgacaaactttgttgttgcgttccgttgttccattgttttggggtagtattggctaccatgaactgtctgactcatggttgtacacaagtgatggtagaacgtttcgacccgttggttgtgctggcctctattcataaagaacgttgtacggctctttacggagtgccgactatgtttattgctgaattgcatcatccgatgttcgatctctttgatatgtcttgtcttcgtacaggtattatggcaggttctctgtgtcctgtcgaactgatgaagcaggtggaagagaagatgtatatgaaggtgaccagcgtctacggattgacagaagccgctcccggtatgacggccacccgtattgatgatccgttcgatgtacgttgtaatacggtaggacatgatttcgaatttacggaggtgaaggtgattgatcctgaaacaggtgaagaatgtccggttggggtacaaggtgaaatgtgtaaccgtggttataataccatgaaaggatattataagaatccggaagcaacggcggaagtgcttgatgaaaacaacttcttgcattccggcgacttgggtattaaggatgaagatggaaattaccggattaccggacgtatcaaagatatgattattcgtggtggcgagaatatttatccgcgcgaaatagaagagtttctttataagcttgatggagtgaaagatgttcaggtggctggtattccttctaaaaagtatggtgaggcagtcggagcatttattattttgcaggaaggagtacaaatgcaggaagccgatgtacgtgatttctgcagaaataaaatatctcgttataagattccgaaatatatcttctttgtgaatgaattcccgatgacgggtagtggaaagattcagaagttcagattgaaagatctgggactgcaactttgcaaggagcagggaatagagattatttagaaactcatgattatttaaagacacacaaagttttttgattataaacagtgaacggtgaactctctgcaatcaattatgcagtttgttcaccgttcactatttgtatgctcttatccggttttgtctccggcgtcaggttgcgtgttattaaatgaaatcatcgcccagttgcatttgggcgtcgtttacatatttacggatagcatgttcttcatctttgcggcaaatcaaaagaacgttgtccgattcggctatcagaaatccttccagtccatcgataacggccagtttgcctttcggaagtactaccatattatctttactgttatatataagtgaatggcacttcagcgtaacattgccttccgggtctctttccgataaatcataaagtgatccccaagttccaagatcggaccagccaaaatctcctaatgatacatacacattatccgctttctccataatgccgaagtcgatggatacattaggacatgctgggaagttttcttcgatgaatgctttctccttgtcggtggcataaatatcttttcccggtgccagtttggaagctaattcaggcagtaaatcttcacttgctttgatgattgtatttacattccacataaataggccggaattccaataaaattctccgctctctacgaatactttagctaattccagttccggtttctctgtgaatgtttttactttatagaagttttctcctgcgggttcgtctatttgtatatatccataccctgtttccgggcgattgggtttaattcctaatgtcagtagcttttccgagcgtgaaacaaaatcaagtcctttttcgatagcggcaagaaactcatcctcttttaaaattaaatggtctgaaggagcgactacgatattggcgttcgggttcagtgcccggatgtggtaagcggcccatgctatacacggagcggtatttcgtcttgcgggttccagcagaatctgttcttcgttcacttcgggcaattgttccttcactaagtccgcatacattgcattggtaacgatgaaaatattttctgttgggataaccttttggaaccggtcgaaagtctgttgtaaaagtgaacggcccgttccgaagaaatctaagaattgtttgggcaatgttttgcggctaaacggccagaagcggcttccaatgccgccacccataatcacgcaataattatcctggtttgtcatgatagtgactctattttaaagtttctgctaatgtacggtttattctctgaatagagaagtgtttaagatatgttttattatttttttctccttttttttgccaaactattgtggaatcaaaataatgtcgtatctttgcaccgcaattgagaaatcaagtatgcgcccagatggcggaatcggtagacgcgctggtctcaaacaccagtggattcacttccatcccggttcgaccccgggtctgggtacgaataaaccctgataatcacctgattatcagggttttctgcttttatagggcgtactaaatgtgtactgaatgacgaatacaaagaaaaggtgtactttaatagttttcttccccatatctttataatttcttaacgcttatcctatcttttcttccttattattgccgatgttttcgggaaaagtgagattcttaccttatatttgtagtaagaacgtttaaaggcacacgattatggaaaatcatatagaaaccaatttcagagaaatacagaagatattagatagttgtatagctcatgactataaaactaaagtagatgcactatttttaaaacgtgaatatttgacgcaagcccagctaaaggattatttgcgacaagaaattttccgtgtgactgaaaatattgtagccatccaacaaaaataccgtgtcgtgcgtaacattgtattggacatggatattcccgattttttgtgggaaagtggttattttgaggacttgaattctgatgaaagaaaaaagtatatcggtttccgctgctctgattttgatatggatgcatatttgcatgaaccgtcctgttatgatgggcggcttccttatttgtccattatcgttaatcttgtcgtgctttccaaatatttgcgctatctgcaagaacaggaaagcaattaccatacagatgcggttgccatccaagagcaagccttgccaaaagagaaagaggaaagtgcagatactaatccaaccaagattgtgggcaaaagcaatcctttcaagtccacgttgaaagctaatgaaatcaaacttctgaccgactgtgtgaatgaagcgaatatgtttactactaccgtcagtgccaaaatacttaccgattttttcaactgcaaactgaatggggtattgaaagttaataatacccgtctgttagcctatcttatgatgcaacttagctgttataattacatcgtttatgaatggcagtctgtcatagcaaacaataaactgatattgaagaagataaaaggtgaaccgcttacacgtactgacctgtcgagtgcgacagaccaagcgaaaaacatctatccgaaaggatatgaaatcatagacaaatacatcaaacaactgcaaaaaggttgagcatagattgaacgctcaaacaaaggtcaattagacttcattttcaagctcttaactttgcccccgttaacaaaaaaacgagggtgcgcaccttcatattgtttcacctaaattcctaaacaatatggaaaaaaatttagagttaagagtttccgaactcgaaaagatgttgttcctttcaaagaacgtgcttagcttcgatgaagcgagcaagttcttgaacctttctaaaagttacctgtacaagctgacttcgggtaacttgataccccattacaagccgcagggcaaaatgctttattttgagaaagcggagttggaagcatggttgcgtcagaacccggtcaagacgcaggcgcagatagagcaggaagcgcagaagtatatccttaaccgtcctctaaagaaataacggctatggaaaatagaaaagcgacagaagccgggcaggacatcaccatgcagaaagaggatttcgcagccctttggaaaaccattcatctaaaggtgacggacacttacgaagtgccgcccgaaatactctgggtgaacggctctaccattggcacgttgggtaatttcagtgcatccacgggtaaagccaagagcaaaaagacattcaacatttccgctatcgttgcggcagcgttgaagaatgacgaggtattgaagtattcggcatacctgccaccgaacaaacggaaaatcctctatgtagataccgagcagagcaaataccattgccacaaggtcatggagcgtattttgcggcttgccggactgcctaccgacaaggacagggacgattttgttttcatcgtgctaagggagcagacacccgataagcggaaacagattatcggttatatgcttgaaaatatgcccgatgtggggttgctcatcattgacggaatccgtgacttgatgtatgacatcaacagccccagcgaatcgactgacctaatcaacctcttgatgcgctggtcaagcggatataacctgcatatccataccgtactgcatttgaacaagggggatgacaacacaagggggcatatcggtacggaactgaacaataaggctgaaaccgtcctgcaaattaccaaaagtacgcaggacggcaacataagcgaggtaaaggcgatgcacatacgtgaccgggagtttgacccgttcgcattccgtatcaacgacagcgcattgcccgaagccgtggacggttatgtattcaagcaacccagccaagacaggggctttccactggcagaactgacggagcaacagcacaggacagctttggaaaacggttttggcaaacaggtcatatatggttacgagaatgtcctaaagaccttgaaacagggttatgcaagtatcggctacaagcgtggacgcaatatccatgtggatttgaacaagttccttgtgaacaagcgcatgattgtgaaagagggcaagggctaccgctataatcccgatttccattattaaaagtcagtttggtttagtccgggtgtatatataagaggaacggacttactatttccctgtatcggaacaggcaggtttagtatggtacgggtatatatataacggactaaacaggactggcgcacttttcaactattttttaatccccaaaaaagaaaatgttatgaacatcgaagatgtgaaacaaatacccatcgcagactatctgcatagtttaggttactctcctgtcaagcagcagggtaacggcttatggtacaaatcaccgttaagggaggaacacgaaccgtctttcaaggtgaacactgaccgcaacctttggtatgactttggcgcaggcaagggcggcaacatcatcgcactggcaaaggaactctattgctccgacagcctgccatacctgttaaaccggatagcggaacagacaccgcacgtccgcccggtcagtttttcttttccccagcgtaggacagaaccgagtttccaacatttggaagtccgtgacttgacccatccggcattgctccgttacttggagggacggggtatcaatatcgaactggcaaaaagagaatgtaaggaactccattttaccaataacggcagaccgttctttgctatcggtttcccgaacatagcaggaggttacgaggttcgcaattcctttttcaaaggctgcatcgccccgaaagacatcacccatatacggcagcagggagagccgagagagaagtgtttggtattcgagggttttatggactatctttctttcctcacgctccggatgaagaactgcccgaccatgcccgaccttgacaggcaggattatgtcatactcaactctactgtcaatgtgccgaaagctattgacgtgctgtacccgtatgaacgcatccactgtatgcttgacaatgacaaggcaggatatgaagcgacacgggctatcgaattggaatactcctaccgtgtgcgtgacttctcgggcaattacagggggtattcggacttgaacgattacctgtgcggcaggaagcaggaacagaagaacagcaccagccaagcgcaggagataaagcaggaaaccggacaacgtgccgccccaagacagaaaaggggcaggggcatttagtccggcaggattaccagcgacaggcggtttaatttggagagcaaggttatgtttcggtaaaccgaaactaccttgctttgcttgacagcaaagaaaatttctcccgttggtcgcaatttttaagataccatttaaatgtaaaaacctatgacgaatataaaggataagccggggggacgtccggcaaagaaacggatagagaagcagcaacgggtagtcagcacgaagctgaccgagttgcagtattatgccatcaggaagcgagccggggaagccgggttgcgtgtcagtgagtatgtccggcaggcggttgtttcggcagaggtcataccccggctgaataggcaggatgcggacaccatccgcaagctggcaggggaagccaacaacatcaaccaactggcgcaccgagcgaatgccggaggtttcgcactggtggcggtggaactggtgaaactcaaaaacaggattgtcgaaattataaatcagttgtcggatgattggaaaaataaaaaagggaagcgggtttaagggctgtgtgaactatgtgcttggtaaggagcaggcggttttgcttcatgcggacggggttctgactgaaagccggggcgatataatccgcagcttctgtatgcagaccgggatgaatcccgatttgaagaagcctgtcggacatattgcgttaagttattcggcagtggatgcacccaaattgacagacgagaagatggtacagcttgcgcaggagtatatgcgtgaaatgaaaatcaccgatacgcagtatatcatcgtgcgccatcaagaccgggaacacccacatgtgcatatcgtgttcaaccgcatagacaacaacggcaagaccatttcggacaggaacgatatgtaccgtaacgagcaggtatgcaagaagctgaaaaccaaacacgggctttattttgctggtggaaaagaacaggtaaagcagcaccgcttgaaagagctggacaagtcgaaatacgagatttacacggctgtaaagaacgaaatcgggaagttcaagaactggcggcagttacaggagcggttagcggaaaagggtattactgtccggttcaagtacaaggggcagacgggcgagatacagggcgtttccttttccaaaggcgaatacacgttcaagggttcggagatagaccgcaattttagtttctccaaactggataaatgtttcggggatgcaggactgaatacggtcggaaatcaacggcagacagcttttacacccgttcgggagccattgccgacacagggaaagactgacagtccgttgataactggctcactcggtctgttcaccgcttcatcaccccctgcggatgaagaaccaaacttgaatttaagaaagaagaagaaaaagaaaaaacaacttaatttgtaaacacatggagaaaaatttgattttagaggggcttctctcaatggttactgaattgaaagagaagcaggaagcacaggtaacgccagccagtcgggaggaaactcttgaaagactgaacgcaatcgaacaggcattgtcggaattgcacagtaacccggctgttcccgaaaaggatttgcaggctatccgaagccagcttgacgagataaggaataggatgcaaggtcagcagaaacatatcgaggacaccaagaaaatagtattggaaacctaccgttgtttcaaggtaatgcttgatgctttgggcccttgcaagacggataaagaggaagctatacccttaccgctctatcaacggatttgcaacaaggtcgcttcttggattcgtccgggattgttccttttttcggcagtgctggttatctgttccgtttccatattcttgaatatccgtttggctgaacgtatgcagcagttacaggacaacgatatgaaataccgctatttgctgatgcaaggacaggcagacggggaaacttttgatatactggaaaacaagttcaaatggcaacgggataacggctttatccgaagtctgaccgattcagtgatggattttgaataccgcatccaaaagcaggcggaagcactggaacgtgcaaggctgttgaacgagcaagccgaacagctaaagaaagaagctgataagctgggtaagccataaacggggaaagccgggatggatgaagcacattcaccgttccggcttttcagattcacttctttttcttcgtacagtgttctttctcgaactggcgtagcgtggtgacgctgaacctttccttgatgaactcccggacatcggaagccttgtaatacacttttccgctgatagtgaagtatggcaacgcaccgatagcccggtagcgttgcagggttttgatgcttactttgaacagcaggcacaagtcttgattatccaataggttatcatcttcgggcagtaccctgtctgcattgcgtagtacccgtacatctttgcagagttcttccagtttggcatacagcttctgcatccatccaccaaattcgtcattgtctatatacataattgcttcatttttcagattatacattttgtttgtcaatcgattgatgaagcaaagttctaaaaacggatacaaagaaattacaggagaactaatggagtcccctataaataaatcataagttgctgattatctatatcctttcttatcatgttcatttttgattaggtttgccagtccattaagaaattcggtgagtttgcccggcttccgttttatcacgtcctcatgtttttggtggcagtcgcttatcttaatgttaaacaaccattcaaaacctttggataagtccactaaataggcaggtttaccgttctgataaacgatgtctttggagaggaataagccgcttaccacttccatgatattgataagggttgttttgtcggcgaggtagagaggggaaaggggctgtttattgatgcgttgctgtagttgttccgggtatttgatgcgccattcaataaggcgtatttcagtgttcaaaagtcctatcgcttcatcaattaaatgcaaatagggcatttttttcttgctcaaaccgtacacgatacgatttaagacggtgtaaaccaaaggaaaaatagcgaagtaaaatactgtaatcctgttcgttgataccaaaatcggctacatgcgtagccaattcctcaatagcttctgtaaactccgatgcagaaactttacgttgtgaatattccgacaataagcggaaaaatcgctgttctaaaattagattcatgtatgtattcatataaaaaataagccttagcgagacttaggaaaaggcttatttcaattcataatattgtaatccgcaagttgttgttttgggggaatttagaaaaatagtttatagcaaagtaatcccaataaaaatagcactaaaaggcatattgtaagaaatatatatatcctaaacatatatatttggtctgattgctccttttctatggtttttttacggatttcttctatcttttcaatggaaacattggataaatcagcatttttacctttgcctacaagatatttgtgatgttctttcatcctgtctctattcaacttgcgaagctcacggttctctttgtcccgttgtagcatatcatttatgcaacctaatgttcccattttccagttaacatttaatttccaaaccttgatatatcaatttctttttgtagttccctaaagatacgttccaaatcatatccatgcggattggaaatttggaaacatccgctttctatggggctattaacctgaggagcagttatcaccgtgtcattgaaaacgaaagcgatgtactttcctacactctttgttgtggcttctctccatataggcaatttatcttggaggaagacaccggtaatgaccgagtgtccaaaagcatcagtttccaaacgtaaagaatcgaaatccataacagtaaggaaaggtgtttgtgaaaggctgtctgtagtctgtgatgttacgtagtaccagccgtttgtccggtgaaaggattttgtctgcatacaagctgtcattagtaggcagaaaaagagaattgttgaaatcttcatatccgctatttttaggttaatacatcttctccaacgtccacaccatcttattgggattataggcttccattacgagatgtgttcctgtgtattccatcactgtccacggacctgctatgttgtcgaacgtgatgatttttccatttacttgataagtaaaatctgtgttccacatatatccgtcttcttcgttcgtccttgtataaatgccttctgattcgttagtaaactgaagaatggattgttttgtgtagtctatctcatcttcgatattgtacacggtcatttgcgcttgccaagtagtttgcttcagggcttcgggggtgaagacagaagtaggggcatcatcgttactacaatttgtcagacataacatggcgcaaataatgaatgtggaaagcaccatacataaagtaattttctttttcatcttatctctattttaagtgattgacaataattatatatttctcttcatagggatactaacaatacctttattaatctcttttttacccacttttttgaagcctaaagatgtataaaaagtttctgcataggttgaagaattaactgttatataagtaaaattacaattgctcatcatatagtcaaataacgattttcctattccttgccgatgatagtgtggcaagacaaagaagagggatatatgttgcctttcccgatgtacaccgattattcctatcaataaatgattgtcaaaagccccatatatgtcaagcgtattcatcaacgatgtgtcatacacgaaacttttaaaggtttcaatcccttcttccgtaaaatcgttaatgccacactctatacatacttgataggataagtttatagcatttttatattcttctttcattaatttccgtatcatactaatagtttttaatcaatgtgtgcaaagtaatgaaaggtggaggaaaaaggtcttgacaattatcaagaccccaatataacaattgttaaaaggtgagttatatctctaacttgcggcgtatgcggctaatggtttccggtgtaacccctaagaatgaagcgatgcttttcaaaggaactacttctttcaagttaggacaacgttccatcaagttcctgtatcgtatttcaggcgtacaatatgaatcaagtaatcgttcatataccatttcaaatagactctctgccacatgccttccgaatcgttgagttttcatatccgtttcccaatattcaataatgtcatgacgggatatttcatatacagaacactctgttatggcttgaatatttactaacgataagccacttctcattaaagaagaatagtcacatacaaactcgttggtgaaagcgtatccaacaatgtgttcttcaccctctccatcaatatatgtatattggaatgtaccgttttctacccattcggcaaaacgtgatatttcattctgacgaataaagaaatcttttttgtggtatatacgttgcttccctttttcatgaaataaatcttttacgagggaatagtctaaattgtcgaggtatgaattaaaatctttcattgtcgtaagctatttattcagtccacggcgtatgcgactgattgtttccggtgtgacttgcaagaaagaggcaatctcctttaacgtaatgtactcttgaatatcggggcatctattcaataagtcaagatacagttctgccgtagtcttgcagtacatatctattaatctatgatacattaataagtatgattgttcaataagagtacattttacttgcatggtttctacatttgtggcaaagaattcctctacttttaaatagggtatataacaaatctttgtatcgcaaacggcttcaattgttactaatgacggttgattaggctctataagtgtgcataaacttcctgtaaactctccggagaaagtatatcctactatatgtatattccctttttcatccacacgagtatatctcaataagccgtgttcgatataagctccccgatgattcactttgccttgaatagtgaattgttcaccctttttgagttcgatataagtaccatgttccaaaatgaactgctttagctgttctaatttcgaatggttggcatattgtgagttaaaatcttccatactataaactaattgcaattaaaatatagaataacctcgtgagttgttctcttaaaaagggaaaatagattcctgactttatcaaaacatcttctcttttttttaatctactttattgtgagtttagtttgtgcttttgtatatatatccaaaacgtaccaaactaacttttgtagcctgcaaaatatatgtgctggcgaaagaagaaacaatcttttttcttttcgccaattttaaagtttgtaactctcatagtttgaggaagaaatgaatacttttatttcttcttctgttggaagttctatcctatacttttgcacaaaaatatttgggtctaacccggcagtggcatacttaaccaaggtatctcccttttcggtgcagagcaaaatgccgataggtgggttatcatccggctgcatcacttccgctttaaaatagttcagatacatatttagttgcgaagcgtactcatggcggaacttatctatcttcaattctacaataacatggcatttcaaaatgcggtgatagaacacaaggtcggcaaagaaataatcctcgtctatcaagatacgtttttgccgggcttcaaaacagaagccatgtcccatttctaacaggaagtgttgcaggttgtcaagaatggcttgttccaaatcagtttctgtcaccaatgcacgttcattcaactctaagaactccaaagtaacaggggtgttgataacatctttaggttgtaataaggttgcttgttgctggactaaagcggagagggcttctttgtttttggatagtccgctacgttcgtaatataaagatgcgatttgtcgctccaactcctttacagaccagcagccacgaatggtttccatttcatagaaagcacgttttaccgggttctcaattcccgatatagtgtttaaatgggtggaagataatctattgaataatctatcagccggaatcatccatgtttcggtttgtgggtattctgttgatagtttccaaactccattttcagattcggcggtcaccaaccgccgaattggttcagtgaattcggcggtcaatgactgccgaatttgaatttgtgatgcaatgtattgtgtaacaggttcttttagttgtggataaacaaggtacaaccgtctaaattccctgaatctacgttcattcagaccttttgttttcagtcgttgttccagcttcttcaacagttgttcaccgtaggcggcacggtcttctccgttctgctcaaattctacaatatagcaacccataagccagttacgggaagtaagggcaaggtttacagcatgtgcggcttgtgcctgcaacgtgttctgtatcgtgctgatatgttttactaatgcttcaaagttcatagttacaaagataagtcttttatggttaaaactttagttcgggcaagctgtttattgcttcctctttcaatttatccaccgcacgggtgtacttctccgtatgcttcaatccgctatgccctaaaaggctggctacggttttgatatttgccccattgttcagaatgttcacggcaaacgaatgccgggcacaatgccagcttatatgtttgtctatcccggctctctttacccaacgctttactgatttacagcaactttcgtaagtaggtaaatcgaatatcaaacagtttttatctgccggggcttcaccaatgatagacaatagaccatcattcaggggaataaccacaccactactggcagaatgtccctttgtcttgctttgttcaaatttcaataaccgattagcgtaatccacattcttataggtaaggtcttttacatcacagaaacgcaaaccactgtataaacagaagataaaagcccgtctgacattcgggttctcgttgtcataatggcaagccgccaacttttgtatttcttcgggagaaagaacatcttttcgaagcatttggctatccactttacaggtaacacttttacatgggtctttcaacattacatcgtggtcaatcgcatatcgaataactttcttgaaacgctggtaaatgcttttagcaccttcacccacacttcgggattgcaaataggctacaaactgctccatcatttctttggtgataagttccggtttgatactaaactcattcatggggtattgctcttttaagaagtccttaaaacggctaagcgcaatttgtaccatgcgaatatctttcttggtataactgttgatataggcttggaaatagtctaagaaattgaccgttctatcttttttcaaccgatagcccaacatactttctttaaattcctgctcacgctccgcacgtatctttgtggcaagctccaatgtttctttgttctgctggcgttccgcaggggtacggggcttatctatcagatacagactaaggttttcttttcgcctgttatgctttactgcaaacttgggcttaccttgcatctttccactatcatagtacacttgattgccgttttcatctaatacgggcttttcctctctacctaaataatactctaagtaaaggctgattctaccatccgagagcttattttgctctaacttggggttttctttcgttttattttctaactttgccattgtttagaggttttatcccgatttaggtaccataaccgggtgattacgctaaatagttgattttcttttgttttccaatattgcaaaggtacaaaagaaaatgatatttcaaagtgtactaaaagtgtactgaataacggaaaatgggcaaaatatggcaaaaatagagaaaataggaaatattcaaatagttgataataaggaagataaattcttttattttcctatgatttctatggcttgtaccgggtctgggtactgaagcggagaaagtagaaatactttctccgcttttcttttctactcctcgtaactcgttggtcataccgaaattcttaatacttataaattcatatagttggttcaaaaggcaatggtgtcaagtacgcctgacaatggaaatggaggcaacggagaaggtggaaatgaagacagtggtgaagcaccggatccggcagcataagaaacggtgttaatatgtaaaaatcgggcttgacattgttcaaacccgattttttctattatataaaatactactttctatcagttaacacctttatcgaatcccgttttataatattaggtttcaaaagaatctccgaatgtagttcagtttcttccaaaatcttctgcatcaacatttttacagcaataatgccaatattctccaatgattgtgcaatacgagtaataggagggttcaaatagtccagatataagttatcatcaaacgaaataatagacatatcttgaggaattctcactttatgctcatttaatgctttgacggctcccaaaagaattgtactacttaacgcaaatatagcagtaggttttgtagtagagttcagagccaacttagtctcaatataaccattctgaatcgagaactcatttcctcttatcattgcgttatcctgataaccagcttcgcgaagcgcatcaagatacccgcgcacacgttccttagttgttatagaaatatccggcccctgaatacagagaatcttactatgccccgattctaataataatttcgttgcctgataagctcctatataattatcagtagctacgtatggcaaattatgcttctcaaaatagcggtcaattagcacaatcggagttctagtactaatttcctcgagtttagaagggttttcaccggttggaaccaaaataatgccgtctattttacgcgatagaagcgaatcgatagctttattttcctgaacaggatcttccagggtatcgataagcatgacagtataattataacgttgtgcttcacggatgacaacacttgctatattggcaaaaaaaggattatctatgtgtggtacaagaaggcctatagtatatgtcgtgttattgcgcaaactttgcgcaactatatcaggctgatagttcaattctttaacggactgcaaaataacctccttagcagactggctgatcctatatttctctgatttcccatttaacactctggaaatcgtagagatagagtacccagttttctttgatacatcaatcagagttttcttcattactggctgttttttgcaaaaataacattttatttgagaaaaaagcaagaaaaatattttgttttgaaaaaaatttctatatttgcacaaacgattgcgcatcgtttacgattcaattcgccttaatacttaatactcattatatggacacaaagaagaaaatcgtagtgataggtagtagtaatacggacatggttatcaaatcagaccgtctaccaaaaccaggagaaacaattctgggaggaaacttcttaatgaatcatggcggcaaaggagctaaccaagccgtagctgctgcaagactaggaggagatgtcactttcatatgtaaaatagggaatgacatttttggaaatgaaaccttggaaatgtttcacaaagaaaagatcgacactacttatgtaggaattaccccgcaggaaccgtcaggagtagctcttatcaatgtcgacaaaaaaggggaaaactgtattgttgttgcttccggagccaacgggactttatctattgatgacatacagcatgcagaacctgccatcaaacaggcatccatcgtcatcatgcagttggaaactccaatcgagagtgtcacttatgcagccaaaatggcgaaaaaagatggaattaccgttatattaaatcccgcccctgcccctacccaacaactgcctgacgagttattagccaatgtcgacattcttattcctaatgtcacagaggctgaaatcatctcgggaatgcacattacagatgatgaatcggcaaaagaagcgattcgttatattagttcgaaaggcataaaaactgtcattattacgatgggagccaaaggagctctcgcctatgaaaacaatgagtttatccacattccagccttcaaggtagaagcagtagacacaaccgctgccggagatacattctgcggcggattgtgcgtagctctgtctgagggcaaaaatctaaaagatgcaattatatttgcaagtaaagcctcttctatttctgttaccagaatgggagcacaagtatctatacctttgagaaaagaaatacaataatcatccttaattctgttattatgataaaacaatgttcaatccacggtctattgacaagtatgttgttaatagtattttctttgatgagcaatgatgctattgcccagaaggcaataagaggtacagtcctcgatgaagcaaatgaacccattatcggtgccagtgtccttgttaaaggtacaacaaatggttctattacaggagttgatggaaccttcaatgtaaaagcgaatccttctgatgtattggttatatcttatgtaggttatgcaactgttgaacaacaagtaggaaatcagacacagcttgtaatacacctgcgcgaagactcgaaagtgcttaatgacgttgtagtaatcggctacggctctaccacaaagaaagagcttacaggatcggttaccagcatgaagaaagatgacctcaatcctggaacattcaccaatgctatgggaatgttgcaaggaaaagtggcaggattacaaattatcaacccgaacggtgctgatccgacagccaaatacgaagtattacttcgcggaacaaacacgctttccgcaggccaaggtccattaattattattgatggggtggcaggtgcagatatcagaaatatcaattttcaggaagtggaatcaattgacgtattaaaagatggttcggcagctgctatttatggaacaagaggtacgaatggagtaatcatcgtcacaactaaacgtgcaagaagtggcaaaacggaagtttcttatgatgggcaactcaccgtgggagtcgtttcacgcagagcaaaacctttatcggcaagcgaatacaaatctgttatcaaggaatatcgcccagaattggaaagttatatttttgacagtgataccgattggtttaaagaaattacacaaactccgttcagccataagcacaacttgtctatatccggaggttccgagaagttctcacaccacacttctttcaattatgaaaagagcgatggcttgcaaaagcataatagctccgaaaagctaatggcacgtaccaatattcgccagtcattattagataaatgggtcgatttggattataacctgaatatcattcatcgcaaatacagcccttcctctacaagtgcttttatgcaggcatttacccataatccaacagagcctgtttatgacgacagcgatccggatgccggaggatatagccgtatcaaagcaatggaatattacaatccggtagcgatcattaacgaaaggaacatggaaagtaagaatgataattatggtgcaaatattcgtgctactctaaacatattgcctataaaaggattaaaatgggagaactttgtttcatacgacaaggaacaatatgagacacgtgaatactacacacattattatccaagtttaataggaacaaacgggcaagcctatattgaaaactatcaggaaaacgatacacaatatgagtctactttaaattactcgaatattttcggaaaacattccattcaggcattactcggatatacataccagtatacttacagcacatctgcatccatgacaaattccggtttcgacttcgatgacaaccagactcataacatcggaacaggaacgaatctaactgaaggcaaagccagcatgtcgtccaataaagaagataatacatatatcggattcttcggacgttttatgtacaactacgatgataaatatcttttgtctgcttcactacgtcgtgatggctccagccgtttcggtgacaataataagtggggatggttcccggctgtcagcgtaggttggcgtataaataaagagaaattcctctcgaatgtcaaatggatcgatgatttaaaattgagagccggatacggagttaccggtaaccaggatttctcaaactacaaatctttgatgatgatgactacagccggtaaattctattacaatggccaatggatcaatacttatcaacctgcaagtaatgcaaatccggatctaaaatgggagaaaaaagcagagttcaacgttggtgtcgatatgacaatgtttgacaaccgcctctcgttcacttttgattattacaaacggactacatcaaacttgctatatgactacatcgtgccaacacctccttatgtatataataccttgtttacgaatgttggaaaagttactaatgaaggagttgagctgacgatatccggtacaccttttaacactagggactttacatggaatacctcacttaccgtttcgcacaataaaaacaaattggtgaaattcaccaatgatgaattcactaacggaacatacaaagtgggatggtctacaagtgctgcctgctacactcaacgtctgatagaaggacagtcattgggtactttctatggtcctatatggttaggaactgatacagatggaaaagatgtattgctaggacaaaatgcagacggttccgtaccggaagaacaatgggaaaaaattggctgtgcttatccggatgccactcttagctggagtaataccttcagatataagaaattcgacttgagtttctcactgcgtgcatctatcggcggagaaattctgaacaactatgcgatggaatatgaaaatctaagcagcatcggacttagaaatatctcatcaaactggttatctcaaacgaatttcacaagtacgacctataaatattcctccaaatatatagaggatgcttcttatttaaaactagataatgttacctttggatatacttgggatttcacatctaaaatgataaaaagactaagattgtctcttactgcacagaatatattctgtatcaccggttattctggtgtcgacccagaagttgccctttccggactggaacccggtatggaaagtttgagctattatccgcgtacaacagaatttacttttggagttaatatagtattctaaaaaataagattaccatgaaaaagacaaatataatattaagtttcgttatctgtatattattatacggatgtaccgatcttagcgaaactgtttatacaggagtagctatgaatgacttctttaaaaatgagaaggaactggtagccaatgcaggtagggcatatacgaaattacaaggatacaattccgaacaaagtttatggacgctacttttacaagcttctgatgaatgtgctgttcccgcttgtggtggttcctggtacagtaatggacgttatgaagaaatccagacgaataaaattccacctgcaaataaattattaacaaggggctggaactggatatttaatggtattgctgcatgtaatgaaattatttacgaaacggaactatcacctatccagtttgaaggaaaagagaagattatagccgaaatgaaaatactgcgtgctttctactattaccaagccatttcttgttggggaaacgtacctttcacaactgactacacggaaaccgaatacccggaacaaaaaagtcgtgaatatattttcaattatctggaaaaagaaattaatgacaatatcgagttcctagacagggagccttcagatactaattatggacgggtcacacaagctgccgcttattgtattcttgcgaaaatgtatctgaatgcagaagcatggttcggtactccaatgtatgacaaagcagagaaagcctgtaaagacattatggatataggtgcttacagcattgaagactcctattctactaactttgacattaaaaacgaagattctaaggagaacatctttgtaatcctttatgatagagtatatactagtggtagcagtagttcattctatctgcatacgctgacattggaagctgcatcacaagcaacatttaatattccggcagccccatggtcgggttttctctgccaaccagactttttccaaacatacgcagaacaagatcttcgcagaagtcagagctggttatacggtcctcaagtagacctaagcggaaaggatcttggtttcgaatatactcctgtcttctccgaagaaaaatattacaatagcaacggaggacgtggcacatacgatggtgcacgctgctggaaatggcattaccagactgatggttctttaaaagaatatacagttagtatggacaacgactttgccatcttccgttatgccgatgttgtattaatgtatgtagaagctttggtacgacaaaacagaacaagtgaggccatccaactggcagacttcaagaagattcgtacaagagcaggtcttgatgcatatactacaagccaattgacgattgatgaactttatgcagaacgaggcagagaactggcatgggaaggatggcgccatgaagatatgatacgtttcggaaaatatctgaaaaaatattgggcacaccctgaccaaagttcagaaacttttagaaatgtatttccaattcctacggatattttaaatgcaaatccaaaattatctcaaaacaaagattattaaccacaattggaaggttcacatagaaaagtgtaccttccaacaaatcaaccctgataagtatgaaaaaaccaatcatctttttacttgttttaattactaacatcttatttatctctgcacagaagatttcaaagacagagttaaaagacaaaatagccggagcttggatcgggcaaatggtaggaaacatatatggacttccttttgagaacaagtttgtagatgaacctgccccggaatccagatttccattcggttacactaaaaatatagataaattgcagaagtataacggtgcattctctgatgacgatactgatgttgagtatatctacttactattaatggagaaatatggcgtagaacctacttatgccaatatgcgtgaaggatgggtgtatcatatccgtgaccgtgtatggctagccaatagggctgcactcggattaatgcatcttggattcacccctccgttcacaggtgacgaaaatctgaatccgcactggtatcagatcgaccctcaattgattaacgagatatgggcgtatacagcaccgggaatgatttcgtatgctgcaggaaaaagtgattgggcggcccgtatcacaagcgattcgtgggcggtatctcccactgtcctatatggtgcaatgtacgctgacgcttttttctgcaaggatatccgcaaactgattacacgagccttgaaagaactgcctgctgatgacagatatgcgatagctgtaaaagagatgattgctttatatgacaaatatcctaaagattgggtaaaagcacgtcaaatcatggctaaaaaatattacatagatgagccagccatgacaaaaacaatctggaatgctaatctgaacggattatgcgggattttggctatgttgtatggcgaaggagatttccaacggacgctggatttaagttgtgcaatgggatttgactgcgataatcaggcagccaccatctccggacttctaggagtaatgtacggtgcaaagtctcttcccgaaagtttgaccaaacctatcgaaggatgggaaaaacccttcaacgaccggtatatcaatatcaccaggtttgatattcccgatgcttccattgaagacatgattgaacgtacttacaacaaagcaatcgaactggtttgctctaaaggaggaaaagtgaaaggtgatatggtatatgttaaccctaaagcacaattcattcccccgatggaattctgtatcggcccgaatccggacttggaaatcggacagcctaccgattactcatttgcctgcagaacaaatgctgatttcaaatgggaactggtaaaaggtaaacttccggcaggagttacattccaaaacggtaaactggcaggaactcctacagaagccggaaaatatccgattaccctacaattaagcgcaaataacaagaactcaatcactaaagactttgagttattagttaaaaccaagaatatagcctccaaggctgatactatttacgcaaatatccgtaaactgaacgaagaggtgctcgattcttgctggattacctttggaaaaccgatgtacgcaacaaatgtagaagtaattaatgacggagtcaaagatggcgtaggatctgtattttattcattagcggccaaaagtaatctgcctaaaatagactatttcggatacggttggaaagaagagcataacatcaatatgcttgttttagatatgggctgtctggaggaattcggaggatggtttacttctctaaacattcaatatcttggaaatgacggacattggtatgacgtaggtaaattcaaatcaactccggcacttcccgaaaccgatattgtatttttccaacctccgtttgcacaatatgttttggaatttccggcagtaaaaaccaagggaatacgcgtactaatggatgcaaaagtgcaggaacactggcataaatacacaaagaatgtatcatcattcatatctattaccgaactaggagtttacgagaaataaaggaagagaaaaatgaggaaaataattacgatatgtatcatagggctttttgctctcaacgtacaggcccagcctgtaaaaacgttaaagttatctgataaagaacttttagataagattaaaggaggatgggccggacaaaccattggtgttgttttcggagcacctacagagtttaagttcacgggaacttatattcaagattaccagccgatcccctgggcggaaggttacgttaaatattggtgggaaaagaagcccggattgttcgatgatatttataacgattgcacgtttgttgaggcatttgatgaacttggcctggattgttcacaagaagaacttgccaaaagatttgcattcgctgattatcatttggcccatgctaaccaagcaggtagatataatatccgccaaggtatcatgccaccggcttccggtcattggttgaataacccacatgcagacgatctggatttccagatcgaagcagacttcattggtctgatggctccggcaatgctgccggaagcattggatatcgcctccagagtaggccacattatgaatagcggtgatggtttttatggtggtgctttcgtagcagctctttatagctccgctttctatgaaaagagtcctgaagcgattttaaaaaccgcaatctctgtcatacctgaagagagtacattccatcaatgtattcaggatgtaatcaatttccattctttgcacccggacaactggaaagattgctggtacttcctgcaagaaaaatggaactgtgatgtaggatgtcccaaaggcgtatttctaaactttaatattgactccaagctcaattccgctttcgtagcattagctatgctctacggtaaaggagacttcaccaactctgtcgatattgcaacacgctgcggacaagattctgactgtaatccgtctacagtcggcggtgtactcggcgtcatgtatgggtatgataaaatcccttcattctggttaaaccctttaaaagaagtagaagactttacatttgaaggaacgaatatgtcgttggcaaaagcataccaaatgagtttcgatcaagctaaacaactcatagtcaaaacaggtggaaaagtatctggtggggaaatagaaattccaatcaaaaaggcggatgtacttcctttagaacaaaatttcgaaaacacctatccactctatagagaacgcaaagactgcttcctgacagatacatttgaatttgatttcaatggtaacggatttgttatctggggcaacatttgctgcacaagaagtattactcccgattatatcaatcgtgtatctacacgccacatcggttccgaggtcttcggattggcagagcccaatgacccttacgttgctaaagtggaaatatggattgacggagaactggaccatgtagcagctttacccatgagaaatacagaccgcaaagtagaaccagcctggaaatacctcatgaaggaaggaagacaccacgttaaaatgaaatggttgaaccgcaaaaaagactacattattcgtatcaacgacataatgtattattcagagaaaaaagaacatgatagattttactttaataaataagttaagatgaaaaaagtcctgattaacatcattctactatttaccttttccatatcgggaatggcacaaatagaatatggaaaaacagttgaaataagtaaagaggtactgctcgacaaaattaaaggaggctgggccggacaaaccataggatgcacctatggcggtcctacagaatttaaatacagaggagcgatcattcatgagaaaactccaataatctggtatgatgactattgcaaggacatctttgcagaagatccgggattgtatgatgatgtatatatggatcttacctttctggaagtaatgcaaaaagaagggataaatgcccctgccgaatcatttgccaaagcctttgcaaatgcagattacaaattatggcatgccaaccaggcagccagatataacatattacacggtattatgccaccggcatccggacattggaaaaataatccgcacgctgacgatattgatttccagattgaagcagacttcattggaatgatatgtccggggatggtaaatatcgcctccaatttttcggacaagatagggcatatcatgaactacggcgacggatggtatggaggtgtatacatgggagcaatgtatgcattggcttatgtaaataacgacatttatacaattatcacggaagctcttaaaacaatacccgaacaaagtaaatttcaccgttgcatcatagacgttattaaatattggaaacaatatcccgatgactggcgtaaatgctggctggaaatagaaaaccgtcatgctcttgagattggctgcccggaaggggtattcaatgcatttaacattgacgccactatcaatgcggcttactgcgtgatgggacttttatatggcaacggcgactttttcaaaacaatggatatagccactcgttgcggacaagattccgactgtaacccggcaactgccgcaggaattcttggagtcatacaaggctacaaggctatccccgaatactggaaaccggcactcgaaagatgtgaaaatattaagttcccttacacagatatctctttaagttctgtatacgacattaatctcaaactattgagtgatgtattaaaagcaaacggaggaaaaataaaaggagataaatactataccacgattcagaagccaaaaaccgtagcatgggaagtttcttttgaaggcttatatccttctgaaagaagagttatcaaatatgatctcggtacagaaaaaacatttgagttcaatggcaagggagttgttttaatggggatgatcagacaagatgttaaagatagtaatgacaattacatcgccatcctggaggcctacattgacggcaagaaagtagaaaccatagaaatgccttatgactacataaaaagaaagtatgacattttctataattatgatttagaggaaggacctcacaaactggttattaaatggattaatccaaatgaaaaatatgccgttcaatgtaaagacatggtggtttattcatccataccggcagagccaatcaatccttataaataaaagagagaagccatgaatagaaaactactcctattattagccttattattattttcctacggattgtcatcatgttcgtctgatgataacagtccgtccgaaggcgaacagaccgagacaccggaactgtttaccaaacgctataatcccgatcaaagtttttacagcaaaatattaggacaagaaatcaaatattccgtattactgcctcaagaatatctatcggaaagtacgggtaaatatggagtagttttccttctacatggctggggagggaaccaaagttcatggggaccttcaggtctgaatattcaaagcatagctgatgcgcaaaccagcaatggtagtattcgcccattgatctacatcatgccggaaggtttcaactcttatttttgtaaccgctatgacggaaagttcaactatatggatatgttcattaatgaactcgtacccctgattgataagcggttccgaacaacaaccagtaagacggaaagagctgttgccgggttctctatgggaggtttcggggcattaagtatagcatcgcaacatcctgaaacattctcggtatcaataggattaagtccctccctaaatacagatgaacaatacatctctttgtcacaagacggttggaatcttcaatggggaaacaacttcggaggaagcggccagacaggaacaggcaggctgacaagctattataaaagccaatgtccgctacactttttcaaggataaaccaagttccacatttcaaacagtacggtattacatagactgcggtgatgatgaagaaagactatatgcaggaaacggtgaattacatactctattacgggacaaaaatatcaagcacgaatatcgtgtacggaacggtgcccacactgacagttattggcgtgaatccatgaaagaggcattgccttttatcgaacgttcattcaaaggagaaaactatccgcaggaaactctgaaaaaattcacagaggaattacatgctactaataaaaacataaaagtaggtaattccaatatcgaactatggttaccggatgactacaattccgaactaacttacaaagttctttattacagcaaaggagaaggtaatgttgatcttacaacaaagaaggtagcagtggcattagattctcttatgcaaatcaaacgtatgataatcgcaggttttaatgtgaaagaaatgattctaaatggaacaaatttttcagctattaccgatgctgtggaaaagacggttcatacggaaagcaatgcagatttcagattaggattaacatacggttcagaagctaattacttatacaatcagtcaacaggcaatgcccctgctatcaactttttctttgcagaagacgcggatattatcaacctttctgccgagaatcgtgccaaaatctattatttggacataacagacgaaggcagcaactacaatagcatctttactctgttcaatggattgcgaggtgcagaagctccggtgcaatatcgtgtcagaaacggactggatagtgaacagtccgcccaaacaggtatttattcaatgagttattatattggtgaacagttaataaagaaataatatgaagaagatactgttatatattatcctatttctatcaggtatagatggagcttgggcacttcccatagaaaaagaagggatgagtatttacagtccgtccctaaagcaagaagtctcctactccattatcttaccggaaggttatgaacattcagaaacagaatatccagtcttatacatgtttcatggaataggaggtgattataccagttggctcgaatacggcaacgttgcccgtgtaatggataaaatgataaaagaaggaaagattcaacctttcattatggttattcctgacggttacctgtcttattacagtgacacttatgatggcagttccctttatgaaactttctttatcaaagaactggttccatatatagataacaactatcgtactcgcaaggatattaatggacgctcgatcattggtttctctatgggaggattcggagcattatccgttagtttgcgcaaccgccacttattcggctctgtcgttgcgttatcgccatccatccgtacagaaaaacaatacatggaagaagggccacaaaaaggatgggacaatcaatggggacggattttcggaggagtgggaaagaatggtaaccagcgcctaaccagttactataagcaacattcaccctaccacattctttccaccctccgcaatcccgatttaaaaggatttggcatcatgctggatattggagataaagaaggtactctttgcgaaagtaatgaagaactgcaccgattattactggaaagacaaatacctcatgaatgggaagtacgttcaggaggacatgatttcgcctgctggaatactgcactgcccaaagcattcagattcataaacgaatatttcaatgggaagcagtcaggaaatagtgagagtagtcttccgaatgagactccgtttatccaaacagccaatgcaacggtctattatccggaacaggctcaaggaagcacaagaaaatatcctattatctatgtacagggagaaatcaacgaacaacagcaaaaggttctcgtcagtcagtttcatcaaatggtagatgagaataaaacatggcctgctgttctttgtttcgtaaaagctaacacagacctgtcagaaacaatttctgatatagaaaagcaactctccggcatcagaggttcccaacgtatgcgggctttaatcactttgggagataatattaaagaaggtatagaagctattcagagagaaaatttgtttaccggcatagtctgtgtaaatgccatcggcaacgagaatgatgctcaaaattttataaaagcagtcaactctcacaaaagatatcccagatgctggatggagatactacccaaatcaaaagaatatggttttagtagtaatatacatatccttttgaaagaatcggacctggaacatgagttccggtcaagaaaatgtaaggaagccaatgttttcacttattgggaagattggatactatatttaaataacagaattcatgtttaacaattaaatactaatagtatgttcacagtaaacagttatttattggcagttatattctgcatcgtaaccatgatttgttggggttcctggggtaatacccaaaaactagtttccaaaaattggcgttatgaacttttttattgggattatgtgattggaatggtattgttcaccatcttgctaggcttcactatgggtagtcatggagataccggacgttcattcctggaagatctgggacaagcatcaggagacagcattggttgggttatcttggggggcgtaatatttaatgcttcaaacattcttctttcagcgtctatttccttggctggtatgtctgtagcttttcctttaggagttggcattgcattggtattaggggtaatcgtcaattatctgggaattccaactggtaatcctttgcttttatttggcggtgtagctctcattgtcattgctatcatttgcaatggagtggcttccggaaaaatgcaaaagggagaagaaagcaggaaaaacaacaaaaagggaattatcattgcattaattgccggtgtactgatgtctttgttctacaggttcgtagtgaaaggtatggacgtagaaaacttcaattctcctgctataggaatgatgactccttattctgccatctttgttttttcaataggcgtattactaagcaattttgttttcaacacattagtaatgaaatatccttttgtcggagaaaaagtcagctactccgaatactttaaaggaaacacgaaaactcatatatgcggaatgcttggtggagcgatatggggacttggttccgcgttcagctatatcgcatcaggagaagctggtccggcggtatcttatgcactaggacaaggcgcaccacttattgccgctatttggggagtatttatctggaaagaatttaaaggttcaacgaaatctgttaatcaactactggccttgatgtttatcttcttcctggttggtttgggaatgatagtagttgccggaaactaattattaaccttaaatagaacaacatgaaaaagtatttttacttattagccatgctggcagtagtactaggtacgactgcttgcagtgatgatgacaatcatcccagtacaaacattctggataaaccggaagttactgttcctgatgtaaaagagagttctgctgttattacatggaaagccataggaaatgcaacagcttatatttatagcttgaacaacggtagtgaacaaagtactgaccaaaatacaattcaactgacaggtttagagccggaaaaaagttatacattcaaagtaaaagctcaaaaaaccggatcaatctattttgaagattcagactatgcagaaatcacttttacaacaacctctgaagtaacagtttatcgaatagccacttttgcagatgattgggataaatggtattacgaatataatgacaatggtacggttaaacgtgtctacaggctatatgaaggagagttggatagagaatggctctttgcttatgacggaaataatatcacagtgacaggtaagaacgcatataacatgactttaaatgaccaaggttatgttgcaacttttgtagatggttccaacacttacgaatatacttatgatgagaatggctacatgaccaaagttgaaaagaatggtaatattgcatctaacatcaccatagaagatggaaatattatgcaatggaccagattttcagatggagtagagcagtttaaagttcagacctattctgccgtgcctaatgtgagcggagcacattgtatctatgcggaaagcagtggagctagtcgttggctggttgaaactggtctctttggaaaagcctcggctaattgccatacgagcagtggttggcaacattcatccagtacagctacttacacattcgaatatgacgagaacagttgtatcaaagaggaaagcaaaaactatgacggatatatagagaatttctattatacatatttctccgaatagcactttatgaaataactaattcatggaggtgtgtctagaagtctggcgcacctccattttttataaagttattagagactttagactgttatatccagtaaaacctctccccttacattcagcaccttaatcctcaattcatcgttcttcttctccagaatcatcaccgtagcactgtccatcttatatcctccaccaataataaccggataattattacccagttcccctttcggatggtaagcgtatttatgagtatgtgcgttcaggctgatattgaaaggtgctttttctaataatttagtccaaagattcgcacagagattcttttcataattaccgtaaagcggaatatgatgaataaggacacgtttctttgctttcttgaattctttggcagacagttcttttttcagaaaatcaacctgttcattacgcaattgggtaaaatcgttcaagccataatatacccaatggtcgtccagtttatcttctccacaatccaacatgacgatacgggtatctccccagttaaaagaggcataagttttatctcccacataatcaaaatggtcacgcaaaccgatagaataggcattgcgaatttcatgattgccacgcataaagaaagtcggtatgctgtcgccatacactccttcggtcagttcactgataaatgtggttgcctgctcgtgatccacaggatcatccacacagtcaccattgaaaacaacaaaatcatacttaacatcctgtatctgtttacacagagcacggaaagtattggtatgttgatgcaaatcattaaaaacaatagcggtaaaagacttcgtatcagcaacaggaagagtaaattcactgaaggccgattgtgctgtatttccaaatacctttttatatgcctgataaagcaacatctcttgcgaacacacacgataataatatttctgtccgggctgcaagccatctatacgtattttatgcagcttgttattacagaccacctgaccgtcaacaatcatacgcgcacgttccagccgggtagtatctgtgccatattccacccagcaataagaaggaacggttgtttcccacatcacagtaatgccattacccacaggattctgtaaataaggtttagtacggaatatcttgtctgccttttcagcagtacgcaattccacaagtatgggacgatggtcggaagccattggctcattaactactctcgcagatatgacagcaaatccggtagcgttttgctttgatgcggcaatataatcaatggtctcttttggatcgggagcaggataagtatgcttttccggattggagagtatttgaaaatccttttgcaattctttgatgaaatcggattcaggttcagcattcatatccccggctagaaaaagaggctttttataggaagcaatcaatgacttcactatttccaaagatttcatacggtcttcttccgttaatgacagatgagtacaacaataaatataatcctcaaattctgccagaatcaaggtgcgggcctcttctctaccaggtaaagggatagtttgtaaacgtagcggaacttgctttgtcaacagtccgattccatatttacctccttcaaactctatagcaggtgcaaaacaggcatgcatctgtgtacgttcagctatttcacccagcacatatttctgtccgctccgacgggtcatactgtctacctcttgtatagccacaacatcaggagaagcattatttatcacattggctacccgttgaaaactacaaatatcatccatgccattcgcatttttaatattataagtcatcagtctcaatgtatgttgagcctgtaccggaaaaataaataagatgacggaaatgagtaaaaagatctttttcatgttcttcatttttgggggttatgttaagttcccccaaaggtaagaaaaaaataaaaagccacaaagatacggattcatacctttgcggcctcttattgtcttgtttgtgtgtctttcatatctgaatatatcagataatccctctcactctatcgtcaaatgcagaaagcgcagctttcgctccttcgcccatagagataatgatttgcttataaggaaccgtagaaacatctccagctgcatagatacccgtcacattcgtacggcaatgtgcatcaatcatgatttcgcccgaacggttggtttccactatgtcgcggaatacactgctattcgcagaaagcccgatctgtacaaatacaccatccaactcaaccaaacgttcttcttccgttttacgatctttgatgcgtagggcagtcagtttatcaccatttcctatcacttccgtagtctgtgaacttacaaacacttccacgttcggcaatgatttaagtcgatcttgaagtacactgtctgctttcaactcatccataaattcaaaaacagtgactttggagcagataccagccaagtcaatcgctgcctcaatgccggaatttcctccacctactactgctacatgctttcccttataaaacggcccatcacaatgagggcagaaagcaacaccacgaccgatatactccgcttctcccggaacattcagtttacgccagcttgcaccagttgcaataatcagtgccggagccaggaatttctccccaacagaggtagtgatctgcttttgttttccaaccacttctactttttctactttacgatgctccagcaaatccaccggataacgcaacaagtgagttttcagattatcggcaagttcatttcctgtcgtttccggaacagagattaaattctcaatacctaccgtttctttcacctgtccgccaatacgctcggccacaatagctacacggagtcctttacgagcagaataaatagctgccgatactcctgcaggtcctccaccggctacaatcacatcatattctttcacctctgcattcgctttggtttcgtcaataccatattgatcttccaacttggcaagcaattcgccaaattcaccacggcctacatgaagcaattttccatctgcaaagacagaaggtactccttgtattttcagtgcatctacttcgtcctgataaagcgcgccgtctaccatttcatgagtaatagcaggattcaaagtgaccattgcattcagagcctgcactacgtcaggacagttcgtacaagtcaacgaaacataagtggtcagatgtatcggacctttcagtgctttcacacggttgcaaacagcctcatcaggaaagttctttcctttgccgtccagattcaggatagccaaaagcaatgacgtgaactcatgtccgttaggaataccccggaatgtgattccggtacgatcaccattccttaataaagtaaacttcaatgcttctccctcattcaccgagcaagtgatatgatcggaacaatccgctacatctcccagcagctccaataattctgttttgttttcgtggctggatgatacggatatatcaaaagtaaaatttgcctccagcccagcaaaaataccctttagttgttcttttaatgcagattctaacataccttttttcctttcatttttttaaaagaaaggccggcagcgtctcccgttaccggcctcccataatcaccattatcaagatctatcaaatcttacctaccaggtcaatgcttggtttcagggtagactcacccttcttccatttagccgggcaaacttctccgtcatggctggctacaaactgtgcagcttccactttacgaagcaattcacttgcatcacggccaatattgttatcattcagttccaccactttaatctttccttccggattgacaacgaatgtaccgcgataagccataccctcttcttcgatatatacacccagtgcacggctcaaagcgccagtcgggtctgccaacatcgggtattgaatcttgcgaatactttcagaagcatcatgccaagctttgtgcacgaaatgagagtcagtacttaccgaatagatttctacacccatcgccttgaactgatcgtacttttcagccatatccaccaattcagtaggacatacgaaagtaaagtcagcaggatagaagaaaagaatcgcccatttacctttcaggtcattgttggttacagtcttgaaagctccgttgtgaaaagcctgaacgctgaattcaggaagttgagaatttaaaattggttccataatctttattgcttttattgttattaattgatttgacttataacatcagaaacaatgttttgttttttgtttctgatgcaaagataaaggcagaacccccgcctttgcaaaaaaagcccaatcgaatatttctatgcggtgatagatgaaattaataaaagcattttatacctttgcatgcataaacaaaaaaactggaaaatatatacgattatggaacatcctcttgaccaattcttatattgccctaaatgtggttcctctcattttgagattaacaacgagaaatctaaaaaatgtgcagattgcggctttgtctattatttcaatccttctgccgccacagtagcactcatcttgaatgagaaaaatgaactgcttgtctgccggcgtgctaaagagccggcaaagggaactctcgaccttcccggaggatttatcgatatgaacgagacaggtgaagaaggcgtagcccgtgaagtgctggaagaaaccggattgaaggtaaaaaaagctatttaccagttttcacttcccaatatttatgtctattcaggttttcctgtacacacacttgatatgttttttctctgcaccgtagaagacatgagccatttctccgccatggatgatgtagcagattctttcttcctacctctctccgagattcatccggaagattttgggttggattctatccgtcgcggacttagcttgtttctagctcaatgccgctaagataatctcatcagcctgatagattgagagtatttcatctatagttatgtcccatttttaagatattcctccaaaacatcagataaaaaaataatgatctggagaataaaatgcataaaaacatgcaactgtatgcaaaatcacaggctaataccgtataaattcaagtcgaatatgcatctttttctatcaagaaaagattcgttggtttaaaaccaaggagttcttccccaccgaggaacgcttcctttctcaccgacgaagcagcttttgctcggtgaggaagacaaataagggaaaattaagaccgtttttcttctatttcatcacaaatatcgaaaaggcaacaaacaacaaaatgccagtttctaaccacatttcagtttacacaacaagtgaaaaagaagaaaagcattacaatttaatcgacaaacatctcatataacaaaaagaaagaatttcgcacctacaaatctctgcgtttttttatatttctcaatcctcccagtaattacgccttttattctcgtttaaatattccttttcttaagatgggccatttttcagtagccaattgatgtatttgtaaaatagaagttcatctcaaccaaatagatcaaagtaatttatcacataatcttaaacaatcatattatattactataaatgaacaaaatacaacatattgtgttatctttgtaaccaccattaatttaatggccattaaattaactgccattaagatagcaataatatgaagttctacgaccgaaagaaagaaatggcgatactgtatgcagctaaaaagcaatcacaaacgagcgcttgctttactgtaatgaccggacgccgacgaatcggaaaaacagctctactcttagagtctgtcaaagacacccgattcgtatatatatttgtagcaagaaagagtgaagtcctgctttgcgcacaatatcaacctgtcattcaggaaacgcttggcattcgtatctatggagaaatcagagagttcgcacagctctttgaactgctgatgcaacattcccaaaaggaaaatttcacattaatcattgacgaatttcaagaatttctctatatcaatccgtctatcgtcagtgacatacaacgtatttgggaccaatatcacgcgacttccaaaatcaatttcattgtatgcggttccgtttattcaatgatgaaaagaatattcgaagaccgcaaggagccactatacggacgccttaccgcccgaatttctctgcatccattcaccaccaccgttatcaaagagattctagcagaccatgccccccaattcacatcggaagatttgctttgcttgtatttgctgacaggtggagtagccaaatacatcaccctattgatggaagcgaaagcatttaataaaactgccatgataaattatgcgctttccgaaggctcaccatttctgacagaaggcaaagacatgttaatttccgagttcgggaaagactatgccaattatttttctatcctatctctcattgcagaaggaaaaacaacacaacgagagattgattccatcatcaataaaaacaccggttcctatttagccaaccttgaggatgaatattcattaatcaaaaaagtgaaaccgatgttcgctaaacctaatagtcgtgctacccgttattgcctgcaagacaattttctacgattctggtttcgctttattttctcaaacaacgcagtactggaaatgaggaaaaaccatttactgatagaatatgtagaaaagaactatgaacaatacagcggcctattgttagaaaaatatttccgtgaacttatcgctgaagaagaggaagttaccgacgtaggtaactattgggacaaaaacggagaaaatgaaatagacctgatcgccctcaaccggtttaacaaaacagcacttatcggagaagtaaaaagaaatccgagaaaaataagtatcccggcattggaaaagaaaggagaaactttacataaagaattaaatgattataaaataactttcaaaggattctcattgaaagatatgtagtacttttgcataaacacccgattatgaaaaaagaaattactagactcatttgtgcagccatctgctgcacgcccattataggatttgcccagacaagtgataagttcacttcggctgacaacctttataaagaagggaaagaacttttccaggaaaagaattatgcagctgctttgccggctttgaaagcatttgtaaaacaaaagcctgcaaccggtcttcttcaagacgcagagtatatgctagtcagttcggcttacgaactgaaagacaaaaaccgcatcgaactcctccgcaaatatctcgaccgttatcctgacactccttatgccaaccgtatttatgcgctgttagcctcctgctatttctacgaaggaaaatatgatgaagcactggcactcttcaactctgccgaccttgatttgctaggtaatgaagaacgggacgactgcacctaccaactggctacctgttatctgaaaaccgataatctacgagaagcagccatctggtttgaaactttgcgcgtcaacagtcccaaatacgccaaagattgtgattactatctctcctatatccgctatacacaaaaacgctatagtgaagcattgaaaggtttccttcccttacaggacgactcgaagtacaaagcactcgtcccttattatatagccgaaatttatacgcagctcaaaaactatgataaggcacaaattgtagcacaaaactacctgtcagcctacccgaacaacgagcacgctgcagagatgtaccgtattctgggagatgcctattaccatttcggacaatatcaccaagccgtagaagcattcaacaattacttgaataaggatcactcggctccccgccgggatgccctttatatgctgggactctcctactaccaaacaaaagtatactccaaagcagccgaaacattaggtaaggtgacaactgacaacgatgcccttacccaaaatgcatatctccacatgggactctcttatctgcaactggcagagaaaaacaaagcacgcatggcttttgaacaggcagccgcctccaatgccaatatgcaaatcaaggaacaggcagcttacaattacgctctttgcctgcacgagacttctttctccgctttcggtgaatcagttactgccttcgagaaattcctgaatgaatttccgacttctccatacgctgaaaaagtcagcagctacctggtagaagtttacatgaatacacgtagctacgatgcagctttgaaatcaatcgaccggattgccaaaccaagcgcgcaaatattggaagccaaacagaagatactgttccaattgggaactcaatctttcgttaacgccgacttcgaacaggctctgaaatatctgaaccaatccattgccatcggacaatacaatcgtcagaccaaggcagacgcttactattggtgcggagaatcctattaccgtttaaaccgaatggtagaagccgcacgtgattttaatgcttatctgcaactcaccacccaacccaataacgaaatgtatgcgcttgccaattataacttaggatatatcgctttccaccggaaagactatacgcaagcaagcaattacttccaaaaatacattcaactggagaaaggcgaaaatgcaaccgtacttgccgatgcatacaatcgtattggtgactgccacctgcatgtacgtaactttgaagaagccaaacagtattattcgcaagccgaacagatgaatacttcttccggagactattctttctatcagctggctcttgtatccggtctacagaaagactataccggtaagattaccttgctgaaccgtctggtaggaaagtaccctgcttctccttatgccgtaaacgctatttacgagaaagggcgttcctatgttctcatggataacaacaaccaagccattacttctttcaaagaattgctgactaaatatcctgaaagtccggtcagcaggaaagctgccgccgaaatcggattattatattaccaaaaaggagattacaaccaagcaatcgaagcctacaaacaggttatcgaaaaatatccgggcagtgaagaagcacgccttgccatgcgtgatttgaaatctatttatgtggatctcaaccgcatcgacgaatttgctgctttagcaaatgccatgccaggacacatccgtttcgatgctaacgaacaagactcgcttacgtatgccgccgcagaaaagatttatgcacgaggcagaatggaagaagccaaaacaagcctcaacaaatacctgcaaactttcccggaaggagccttcagcctgaacgcacattattatctctgcctgatcggaaacgagcagaagaattatgatatgattcttctccattccggtaagttgttggaatatccaaacaatccgtttgcagaagaagcactgatcttgcgtgctgaagtgcaattcaaccagcaaaatatggctgaagcattggctagctacaaaatgctgaaagaaaaagcaaccaacgtagagcgccgccaacttgctgaaacgggtattctgcgttgcgccttcctattgcgagatgacatagaaaccatccatgcagctaccgacctgcttgcagaagccaaacttagtccggagctaagaaatgaagctctttattaccgtgctaaagcctacaccaagcaaaaggctgacaagaaagcaatggaagactatcgtgaactggccaaagacacacgtaactcttacggtgccgaagctaaatatcaggttgcacaatccctctacgacgcaaaagaatatgccgctgcagagaaagagttgctcaactatatagaacagagtacgccacatgcttattggctagcgcgcagttttatccttctatccgacgtctatcatgctacgggtaaagacctggacgcacgccaatatctgctaagtctgcaacaaaattatcaagggaatgacgatattgaaagcatgattgaaagcagacttagtaaattgaaagttgagaattgagaataaaaaaatagaaaagtatgaaacgatctcattatataataggaggactcgcattggcaatctcaatgccatcctgccttcaagcccaaaccacccaaccgaaggatacaacaatgacccgcacggtcgttgtggaacaagaatataacccggacattatggacgcttcgaaagtaaacgtcctgcctaaagtagaagaaccgacagtgagcaagaaagaagtagagtatgctacaacattctttccggccacttccgttccggcaggcctgatgcgcccctataccggaaaagaagttcaacccggtactaccccgggatatgtacgtgccggatatggtaattatggcaatttggatattcttgccaattatctattccgtctgtcgcagaaagacaaattgaatgtacgtttccaaatggatggaatggatggtaagttaactcttcctttcacagactctgaaaaatggaatgcattttattatcgcacacgcgcaaatgtagattacacacaccaatttaataaactggacttaaatattgccggaaatttcggattgagcaacttcaacttccaaccggaaagcgtaaacagcaagcagaaattcacatccggtgactttcatgcgggcattcatttcactgatgagactgcaccactgcgtttcaacgcagaaacaaatctgttgatgtatgaacgtcagcacaacatgttcaatgaatctgaagccaatacaggtatcaaggaaacaatcatacgcaccaaaggcgatgtcacgggagctatcggcgaccaacaattaataactatcgctttggaaatgaacaatcttctctacaacggatatacaaagaatgtttccaccggagatgaatacttcaaaaactacacaacgcttcttttaaatccatattacgaactggataatgatgactggaaattgcatatcggagccaatgtagatttatctttcggatttgacaagtctttccgtatttcacccgatatcactgcacagtatattttttctgatagctacattgtttatgcaaaagcaaccggcggtaagcaattgaatgatttccgcagattagaaagtatctgtccttacggtgaactgccggaggcaaatactactttgggatacgtacaacgtccttatgatacttacgagcaaatcaacggtagtatcggattcaaagcaagcccttatccgggactttggttcaacgtgttcggtggttatcagaatctaaagaacgacttatcttatttaggttttgacccaagtaatattcattcaggttcttatctttcttttgcacaggataatacagacaatctttaccttggaggtgaaataagttacgattacaaagatatcctcggaatatcagctaaatatacttaccgtaattgggacagcaaaacagaggaatatctgttggctgtgaaaccagtcagtgaaatgtctttcaatgtacgtattcatccggtctctgctcttaacataaatctaggttatgattacatcagccggaaagaagtgaaagaatatgcaaaaatgaccgcaattaatgatttgcatatcggagccagctataatgtattcaaaggagtatccgtttatgctcaagtacataacctgctgaacaagaaatatcaatattatttaggttatcctacggaaggattcaatttcttaggaggattgagtttccggttctaaagtttatcaataaatcacagtaacagttataacacgagacactcatctcataaaaaagagggcatctcccatagggatgatgtcctctttcaaaccaaaaacttaatcttcaattattattttgttatcctcacaacaaacccaccaccaggagccatgtgtaaattcaacttcttattggctgatacgcggatcacttcacgcttatagtctttcccaacacgatcggcattgataccatctctaaatatttctgcattgaactcaccatcacccaagaaagacagatcgacttcaacatcacgctctttccagtcggtcaatccacccacataccagataccgtctttctcacgtgccattacaatatgttcgcctacttttccgcttattggaagtgtctgattccatacagtaggaatggcagcgataaacttcgtacattcttcctctttcagataattagtaggtgcatcacacagcatattaataggagaatcaaaaatagtatacaatgctaactgacggcaacgtgtaccctgactcatcggttctgtatagacagcatgaaagttcttcatgattacgttattcatcgctccctgtgtataatcaagtggtccggcaaccatgcggatgaaaggagctgtcacatcatatatcacttgatctgttcccggttctgcccacttcatttcttccagtccatggacaccctcgaaattgatcgtattcggataagtacgttgcaaaccagtcggtttgaacgttccatggagatctatcagcaatttgtattttgctccggtttcagccgctttacggttaaactcaactacttgttggtcgtcacggtccataaaatcaatcttgaaacctttgattcccattgcggcataatgcttacatacacgatccatgtctttttcaaaagcacgatagcccgcccaaagtatcaaatctacatttttgctttttgcatagctaatcaactctttcaaatcgatttcaggaatcacctcaaacaaatccgctttacccggcactgcccatccctcatccaatatcacatattcgataccgaatttcgaggcaaagtcaatatagtatttataagtctcattgttgatacctgcgcggaaatccacgttgtagagattccagtcgttccaccagtcccaagccactttacccggtttaatccaagaaaaatctgtaaattgtgccggagtagccagtttatataccatatcattacaaagcagttctgcatcatccttggcaatgaccatgacacgccagggaaatgctgtgtttccctccactctagcaatataaggttcacgagattttactacccctttcagtccgcgaacttcgtctactatcgttttcggataagctgcaaagattccatccagagaatatccatgctcaccatgtttcacatacatacccggatagttcatcaaatcggcttcagtgatacagattttttttccgttctttccctcgaccaaaaccggtaaaaaggcaatctgttccttatcccatgcagacaaggcagtttccagatacgtattttggaaagaactgtagaaaggatctttcttgccctcgttcattcggcctttcggtgaagctacaaaaactttcggatcattcggaaaacagaaagaagcctgctcgctttccaccataaacggcttcttcagttcagagacaaaacgataggctgcaccatcttcataagctctgaacaccaagctatatcctcctttaaagtcaatggttagttcattgaactggtccttgattgatttcttcttatagatgggaggatagatagtctcatttacagaacggcggctgatcttctttactttcggattgagtccgaaagctgtaccatcagttagtttcatgaaaataggagatggagccaccatcacatcgttgtcgtgaagaacggagtattccacattcttatcattcacaatcacattcacctgcactttaccggaaatgtctttcagctcgtacactttctgtgcacaaatggttaaaggtgcgatagccattagaaccggcaaaagtcttttcatcatacgtttcataaactaatactttttgtatttcacacagttttttatttacatatttatcataagagtaccgcttggcagagataaaggaggaagcttaacaggaagaatttcctgctaataaagcattgaacaagtgctaaatagcacctttcttatctcattcgcgctaccattttttagaaatcaattgtcacctgataggtatccttattctcaaagaaggtctgttgcacctcatattcgggaagccatacgtatttttttcccctttatattcggcttcgagcaagaaagtgaaccagcggttataaggcaattcgtcggtatgcaaaggaggtgcggggctatcatataagttggggacaccagttatcagatattctcctttcttatccgtctcataagtacggtaaggagtagcgatcaggtcattgaattttgcacgtgaaccatacagattcagctttacccctttttgctttttacctttcacttttacagatacctgtatgttttcggggaacatttgtttgaagaatccgtcgaaatcacgtctcggacgtttggatttggcggtgtgattgattatatgaactgcatacgagctccatttatatgttttataatgactgttcatcacacaagagtcaggttcatattcgatatggttcaccggattgttctttgcccggattctatcagcatacaagtcggttaccccacgataatgtccgaactcatgtgccactcctctatgaaaatagtcgataccaaacagatcttcatgttccgtcttgctacggctacggcaaattaccatattcagatcgtccgccccaccgccgcaataccatcctttagccgattcttcatcgtcaaaatcaagaatagaatctataatcagcagtacatcgtgattgggaaaaccggcactcttctgatagattttctccaattggcgggaggagcagtcgtaaatcacctgcagatccggtatataacggaaatagtagttgaaacgtccattgccggctttgttccagaagtcgttcacttggtcgaaaaaagcattcagcttcgcttgataagcttctttacctccccaatgctccactccggccttatcgacagccacaaatacccggtattcaatggtgtccaaagattgtcgaatctgattttcctccaatgtctttgcctccatccaagagaagaaaggcaatagagcgggaaatatgagccatcttttccagttgtttttcatattagttcttagttaagaatgtattttatttcttgtaaatcacgactatttccaccgaccatcaaagtgaagtctcctttctccacaatgaacttcatttgattattgtagaatcctagttgttcatcttttacgtcgaaggtgaccgttttgctttcacctggactcagcttaatcttttcaaagcctttcaattctttgatagggcgagtgatagaagccacctcatcacgcacatacaactgaacaacttcctcgccctcgcattttccagtattggtaaccgttacagcaacacgtgtataagtaccttttccatcacccggaagcagtttcacatccgaataattgaaagtagtgtatgacaaaccgtagccgaacggataagcaggctccgtaggaatatcaatgtacttcgcacaccatccgcccaatgcagtggggcgtcctgtgctcttatattgataatacaatggtatctgtccgttatgctgcggaaaagtcattggcagcttacccgaaggattataatctccccaaagtacattacagatagcattacccgcttcactccccagccaccaggtacataagatagcgggagcctcccgacgaacttcattgaaaataacaggacgaccacacatcattagtacaactaccggtttgccagtcttcaccaattcggaaaccaaacgctgttgttcggcagcaatagaaatatctcctttcgaacgcatctcaccgctttcccaagcttgttctcccattgcaacgataaccacatccgattggcgggcagcagctaaagtctgatccagatttacaattttattcgttttcaagtcgtagccatcgttatagttgatgtccactcctcgtttctccattgcctcatacaaggttactactttaccaacctctgcacaggaccatgcaccgcacatatctttctgcgatttggaaagtgcaccaatcaaagcaactttcttgatagaagaagaaagcggtaacaccgagttttcatttttcaaaagaacaatagaacgttcggaaacgtagcatgcttccttgcgggattcctgtgaaccaatcactgtacgttccctttcttcatcacagtatctgaacggatcatcaaataatcccagtttatatttctgttccaaaatacgtctgacagcatcatccaccagcttgatagataccttaccctcttttaccagagacaccagattcttggaatagcattcacttaccatctccatatccagtccggccttgattcctttataagcagcttctttttcatctttcgcataacggtggttcatcatttctcccactgatccccagtcggataccacaaatcctttaaatccccattgattcttcaggagctccctcaacagaaaagtacttccggtagacggttcgttattaaagtcattgaacgcactcatgaaagtagcagcaccggcctctgcaccagccttgtaaggaggcatatagaaattgacaaactgtcccatcgacatatccacactattataatcttttccggcaatagctgcaccatatccggcaaagtgcttaatacaggataaaatagtattctctttcgataaatcatctccctgtaaaccatgtacacgcgccttagcaaccaacgagccataataaggatcttcaccggccccttccatcacacgcccccaccgggcatcccagctaatatccaccattggagcaaacgtccaatgcaacccggctgctgcagcttcctttgccgcacatctcgatcctctttctatagcatccagatcaaaactcgcagcctctgccaatggcaacggaaaacctgttctatatccatgaataacatccaatccgaaaagcaaaggaatctgtaaacgtgatttcatagctgcctcctgatatttacgagtattggcagcaccggatacattcagcaaagaaccgatcaatcccttacttatatcttctgtccgactgatacgtgtattatcaggacctgtggcaaatccaccggaacattggcttaactgccccactttttcttccagtgtcatctttttcatcagaccggatatgaaacgattcatttgagcctcatccttttgattctgcgccatgcttcccatagcgaaaatcgccatacacgaatatgtaattagtcttttcatcattttattataagagtttatctgtattgatttaaatgttaatatcctccatacgttttactttctatcgcaaagatagccgctggtcagattcacattggcgaattgcgtacaaaaggacaataatatcgtaaagtctgctttttttctatttctttccgtatagcattcaagcacttctgtcatttttttgcctttattgatacgattttctccttactcttcacttattcgtaagagatattatccagcacttttattccctccaagataaatattacacatatacaacttattattagatatataagtcgatacaaatagcataaagtaacaaagtaacaacaatagtaaagaatatatgtaatttccgaatccttgattacgaagtacaggtttaatcgacttccattacttgggagattatcctataaaagcaaaaattcttcattgaaaatcgtaaaatatcaatcttggcgtatttcctttcattttgtttcatgtttttgaaagaaaaattatatctttgcattcggactatagcacccctacgcttatttgtttccgatagacgtgtctttcacgacaatggctggggaagttcacgccgagcctagtgcggcgaagtcatacgaatgatgcagttgcacaaagcgggctttgggtgggaaagtatagtccatacataatgaaggcgtttattcgacgctgtgtttaggacttcctgtaatctagcaaattcacagaatcatagtcttgaacctagcaacagtagatgtcccgggtgtgattatatcatccccgtggagaccttgtaagcatggattgtaccctttcgggcacaacaaggttgtttatataggtctctttacggtgtttgattattcatatcggcgtgggctctgacgttgtctgttcaactatgataggcaattgctagagcctcaggaagtggaatggacaacaggacgattccacgtattctatgtgctatcaactgagttctgtctagaataaagttagcaccgatatgaatatcaatgaacttgcatctaaatatgcaaacactcatggaggtgatatagttcctccttgcaccggacttacctccgatgccctctccgaagttctaaagcctatgatggtggagaactcagatacaggggtgtccaccagaaatgcgctgtcggcaacccaccccccattacattccaccttccaaacagacaattctcattggtacgctctacgtaccacttacggaagagaaaagaaagcatacgattatattataagtaaaggtggaacagccttctatcctacactttccaccgttaaacttgtagatggtaaacgtaaaacagtagaagaatcgcgtattcccaacctcttctttgcttatggcacagaagaagaaatcaagtcttttgtttacgataacgtaaacctccattatcttcgtttttactatcgtcacttccacatcggcaataaaatcgagccactgattatccctgacaatcagattgagagtcttcgcataatctgtaaagcagatgcggatgatatcattgtatctactgatgaggtgcaaaaattccaaaagggacaagcggttcgtatagttgaagggaaattcaagggggtaacaggtattgtggctcgttatcaaggacagcagcgagtaggaatagttatagatggtttgctaactatggctacagcatacattcctaatgcgtttcttgaagttgtaaaaaagtaaaatatttaaataagctaacataaaaatgaaaaagtcagttatgatgcgtggttctattattggcctgagttgcatatacttaatgatatgttctagctgtaaaaatccacgcagtggtgagtcgaaaggtgaatataataccaaatgcatagaaaaagtagagatagaacctactacatataatttctacgttgaaaactcaggtagtgtaaaaggttattttaaagggtatgtaaatgatgctggtaatatccttaaagagttttatgatagaatagaagaaaacaaaggagatggcgatactatttcgctaaactatatcaataatgaaactattccacaaaaaagtgatataaatacatggctcaaccagatttacacaaattgtaattcaagttattcagatatagataaggtccttgagcaaattctatcgggcactaatgacaataccgtaaatattgttctttccgattattgttttgaaagtaggttcggaaatttagataaagcaaaatcagaaatcaccaagattttcaccaaaggaataaataaatataacgatttatctattgccatatataaatacgaagcgtcatttgacgggtattattttcctggtaagataaagtataaaggtaaacgaccactttatttatggatttttggccctagtagaaaggttaaagatgtggttaacttgccagtaacattagaaaatgaagcaaaaatgttcttgcaaccaatggaaacatgtgcaacaaaggttgttacaaacaatgcccgaatgactgataaaggtaaagacataattgttaagcattggaaagaagaccgttatgaaaacaatctgtacaaggttgatataaaagtagatttatcaaaggttataatttctgacttggaaattaaagatgttcaaaaatacacgatagtacctaatgattactatattgataatataaaatctgaaagtaatggacagtatatctatacaattgcaactaatcgacgaccttttgcatgtgatttaactattggctatacaacaaaattaccgaattgggttattacatctaattttgaaaataactcacttcctaaagatagtacaacttatggtataaaatcactaattgagggagtaaacaatgcctatcaaaataaagacaataacatttttacaattaatttaagtctaaaataatatggaagatttatttaactcgatttactattacacaaatggcttctatagtgtagaacttgattcatatctctatgaaaccataccaggctatctgcacataggtgcttttatgcttatttgttcttttgtggtgtgtgcgatattctactatgttttagctccagtgcgcaagcaaactatgtggtggtttgtatattctggcataaatgctatcatcaattttgtatttgcattatggtacacgatgacaccattaattaacaatgaagttgacccatcagaagaatggtcatatttggattgtaccatgtttagcttcactaatgtgatttggtcatttatcttctttgtggttgcatcactaatcataaaatggggtagcacagcaaaatatgtaccttttcaaaaattttaatatcataatatatgagtaagctctatgtttttgcaataggcgggtcggggtcgcgtgttttaagatcgcttacaatgcttctttcttcaggtgtacataccgattacgaaattgtccctatgattgtcgatccggatcaatcaaacggtgatttggttcgcactgttgatattatgcgctcttatgaaaatattcataatgctcttagttttaacaataatgaaaaaaatgaattcttcaaaaatccaataagtgctctcaataacgatggcaattatctacttccattgattggaacttcgggaatatcatttgaaaattatctgagtcttagcactatgtctttagaaaatcaagccatcatgagaatgttgttttctaatgcaaatttggcttcagatatgaatgtcggttttaagggtaatcctaatattggcagtattgtacttaaccaattcaccgactcaaaagactacaatactttcgcaacgaattttgttaatggcgacaaggtatttattatcagttcgatatttggaggaacaggtgcaagtggttttcctcttttgttaaagaatatgagaacaaattccaatactgcattagcaaacgcaccaattggagcagtttctcttcttccatattttaatcttaaaacagacaaaaagagttcaatccaagcagattctttcattacaaaagcaaaagcggctttaaactactatgagaaaaatgtcaccggtaataacactttagacgatatgtattatttaggtgatgatttttcagctgctggttacgataattgtgacggtggtggtaatcaacaaaataatgctcatttggtagaaatgcttgcggctctttctattattgattttgccggaaaacaatctcaacagaacacagtgaaaaataccaattttcatgaatttggtcttgaaagtgattcacaaaatgttatgtttgctgactttggaattgaaacaaataacataatacgtaagccattgtctatgatggcgattttaaattcatatctgaacaatcgtgatgcctcacatcgttcttcacagaaatgggcaaaagataagagttctatcttgggggattctttttggagatcttccaatttcagtacatacaacaaatataagcaatgctttgaagaatggcttagtgagatgaaagaaaatcatatttcttttgaaccatttagaccggataagtcttctgtagatgctttagatattgttgtaggtattacacctcactatggctttttgtcaaagaaaggctgtgactatatagacaagaagctaagtgataacattggtaaaatctccgctaatctcaatccactacaatcttttcttgagctattctatattacgcttaaggaaatatgtgaaaacaaacttaaattgtaattatgggacacattttcagattaaaaagagcaggtattgttgctacaaagactactatcgtcgattggagcaattcaactgcaacaacatataatcatgggtatgttgatggaatctctgatgctacaactacgcaaaacgagataacttcaattccttctccttttgcgagaatagaattggtaaaggaagcttttggtaagattattccaggcacattaaatcaaatgtctgttgacgatgtaaaatcgcacctatcaggcaatacaatttatcataaaatggtatctgacaccttggatgtagctcaaatatttttctcatatccaaccatgcaagataaggttgacattgttgtttggaatatgaatcaagaattgcagaagctattgttgtcacctaatccgaatcaccaagttgctggtagatcattagacatgttcctcaagcaagatgccttaggaaatgacccatacaactttgggaaaatgaagaatatgtatattcttaaatataagggatcaggacagaaacagatgcacatcattggggctacttcacctgcaacactatttttttctacagctaataacgagtctgctatatcaaaggagctatgtttcggtactgattatgcatttgattcaaactattcatctcttgaccaaagagatccagaattcttgaaatatatgtttgcatttagatactcaaatgcgaactttaataatgattatcctgaggttgccaaatatatggatgctgtttacttcgttcttgataatagcctcaaaaacgaaattaatagcatccaaaatcagtgtatttcaataattcctggtacaaaaaacttcgtagataagacttatgaagctcttagtgtcaatattaatactacaacatcttttgatgtcgaaatcaatggagtttcattccattgcaaaagagctgttgtcacaggaaactctgattttgaattacaagctctgaaatcgacagaaacattaccgttagttcttcctgttgtcagaggaaacgcttatgaaaacatggagtactatggttctaaatttggtagaagttttgatgtaccatattatgatgctttgcctcttgcgcaacggcgtctgcctggcattaatatccagcatccttatttaactatcagcgacttccttgaagataaaattataaagctcccttctgctattaataaagcagactattttgatggcaactatcagagttcaaatggcaatgttgaaggttatttgttcccaataaaggatactttctttgattactttacatctgattatttaacgggcttggctccatcaggtaaaaaggcttttgaaattaagcaagtagcttccggagttgaagtatcactccgtgtacctattaaggctggagaagtagaatataagcgaatatatactcttgatgttaaagcagatgagcagaacaataagggtgcaattgttgttcctgatgaggatttagcaataggtgtatttcctcctgtaaaatttgctcaagaggctgatgcacattatagaatcgttattctttccgatcattctgtaaataaagactgcacttgtgtttgttatactaatattgctggtaagtttgtaccagattatgttactagaaatgtggacattcaagaagaactaagttcaaaagtgtacttgttggacggaaaaacttttgattttgcaagagtttctttagtttcagaatctggaaaagaaagagtaggcagtggattgttaatacccaagtttaaacaacgtgcaggtgccgcctcgttgacatttgccattgacttaggaacatcgaacacacatatagagtactcttcaggtgatgaccaactacctaagccatttgaatttaatagcgaccagccacagttcagtctgcttttttcaacagatagtgcggtggttatggatcatattagaggtgagtttattcctgaatctataggtgtgaacgctaattgtcattttcccatgcgcactgtcctttgcattgataaagtaaattccggacgtaatggcactggaattggagcatatgagccatttggcaatgcatctcctgcatttatgtataatcaaaaaatagtaggcacaaagtacaatgagtacgtccctaacttaaagtggagtcaagctagtcccactaatgagcaaagaataaaatgttatatcgaatctttgtttatgatgatacgtacaaaagtagttcaagaaggagctagtatacagcaaacgcaaatcaaatggttttatccaataagtatgtctgcctttaagaaaggactatttgagcgtttgtggacagctgcgtataaaaaatactttaatcaaaccggagttccaacttctataacagaatctgttgctccatattcattcttccaaaaaaccagatctgatgtgactaatatcgttacaattgatataggcgggggtacaacagacattgttgttgcggatacaaatggtgtaaagtgtatatcatccatgagatttgctgctgatgcaatctttggtaatagcttagttagcgttcaaaatggagaactaaacggtattatcagacaatgtaaagatgatttcatttcaaaacttgaaggtgaagaggaattacagaaaatgctcatccaaaagactgctaataactatggtaattcttctgaggttgcatctttcttgttttctcttgctgataacgaaaagattaaagcaaagtctatgagtgatgcagttgattttaatgcgtatttaatgcgtaatggaagccaaaagatagtattcttcatcttctatacttctattatttatcacttggctcatctcatgaaagcaaagggattagaagttcccgcgaatatagcgtttagtggtaatggttcgaaagtagtatctgttctaagtcctaataaatcttctcttgagaagctaacaaggcacatttttaagttggtgtatgattctgatattgataaggatattaagctgatactaaattctgagaacccaaaggaagctacttgtaagggtggtttgttcttgagccacgaaccaactaatatagaatccgcgaagagtattcttttaggagtttcaaggaacttactgtgtgaatcagaaacatatgctgatgcacagacaatgtatgatgatgttgttaaagacgtaagagcctattttaactttattgctttgaaactagcacgtattcagggattttcgttaagtaacgagtttggtattgataagcaacatcttgatttagctgcaaagtgtttcaacgagaacctgtctacatatgtagagaaaggtgttcgtttgaaattggatactagtgatgtcagtcttgatgataagttagaagagactctattcttctatccgataattggtgtaattaatgatttaagtaatagagtttgtgaaaatgaataattcaaagagaagaagcggcttgtttttgtttcatctgcttgcatacagctttaacaatactctttttgcccaagatagtatcaaggttaagcaagattctatttttgaggaattgacttcaaaggtgaattgtctagaaacatcaacaagagatctaagtaatagcttaaatgaatccatacatcataatctaattagtggctttccagacatatatttgattttgatactttgtggtatcgccattttatttagtctatatgcaatctataaagcacacactaattatgcatatagtcattctgatatggattgcgacaatagtttttcattcaacgaactgaaaaaagattacacgaaaatagaagatgaatttgtacagttaaagaatcgtatacacgtccttgaaagtcaattgagtaattcacgaaaagtacaatcaagctctacaacaggaggtgtgaaaaagaatgcttttcgtgaacagggtactaattctatgttacccaacacagtgaagccaaaagataataatgacaaagttgccaataagcaagcagaaactcgtgaatatatttggcttaaagctgttgatggaggaaagttgtcaatagctcaatctgctgatgttgccatgtatagagcgtggaaaagcaatggcatttatgcttttgaattttgttgtgcaaagacaggtaaagctattaataaccgaactagcgttattgatcctttctgtgaagttcaaacaaacggaattgatccagaccaagcaaagagtgtaaatgtgaagaagcctgggagcttgtctagtgactttcaagttctcacaaaaattataatccaatattgttaagttatgtttgaagtcaatataaaagtagatccgcagaattcttctgacatgcagcgtgcattagaattcattctcaatcaaccttgtatgagtaggttcaaagagacatattataataaatcgtcctatcttacaggaaatttggctggtaatagtagaaacaaccaagaactcatcgataaaattaaggaacttgaaaaagaaattcaaaagcataaaaaagagaacgaaaagaaccaaaaactgctttcagataaggatgtcgagattgaaaagtttcagcaatcattagaagagcaaactaagaaattcgatgaagaaaacaaaaaaaacaacgaacttgaaagtggttgggtaaaagctcttgatgagaaagaaaaaattgaagaagaggccaaaagccagttagaaacattaaaaaaagaatataacaaaaatctaaccgataaggacaaagaaatttctcgtcttaggaagatgctggaaagctattctgttagtttcggctctgatgatccttccgagaaaatctattttgaagtatcagaaaatggtacactagaagagagcatgatttcgtctgattctctatattgggcaagcaaaagtggcagtatttacaaatttacaattaatactgacgatggtcctatgattaaagccatatcagatgttaatcgatatctcattccatattgtgacatccaaaatcaaatggaaggtgccaatacaatccagattatttctattggagaagcaaaactgatgatgggatcatttcaagtagaaaagaaagcggttatttcattaattaagcaataaactatgtctgttcaatattatatagtagcgattgtcgtagcatttatcgttgtccttcaagtaattgcattctttaagaacctgtcaattattggtaaacttagagcattgttccctaatacaaatacattgtcattacataaagaaagtaacacaatagaatgctctcttaatcatgcagaatttgaaggaactttgcatgatattaatgggtatctaaatgaaaatcagaatacgtctgcagattatcagataatcaaggagatagttgaaagagattcccaaagaatagaggaagatgttgatacaatgttatcgacacccctttatcttggccttatggctacaattttaggtgccgcaattggagttgtatcttttgcttggacagaccttggaactttattgacaggtactaatattcaggtcgaaggaattaagactcttctgactgatattggtattgctatgattgcaagctttcttggtgtcatgtttacagccatttctacctcaaagtacaaggaggcacgaggtgagatgcttaagatgaagaacaaatttctgtcttggattcagacaaaagttatgcctaatatgtcagataaccttaccggtgcacttacaaaaatggcaaatgacttaaacaatttcaatagtacttttgctgaaaataccaaagaattaaaggaaaccttatctcaagtaactgacaattatgacaatcaagtaaaattacttgatgctattgataaaataaagattgctaagattgctaaagctaatgtagaagtatatgataagctgcaaggatgtacagaagagttggaacgcctttttgaacatcttggaaattcagaagaatatatagctcaggtagttaaattgaattcacgcttgggtgatattgaggacaggactcgtctttctgaagaattaggtaattatttcaagagtgagattgaatatgttcaagacagacaaggaatgatgagacaacagatgtctagtctagactctgttgttcaagatgccttggataatttaggaacaagtctagctggaagtatctctaatttgactgaggttttccaaaagcaaaatcaacaagttcaagcattgattgaagaacaacaagagagtctttcaaaagcacttgaagatcaacgtgtagctattaataataagatagcagaaattaatgacccatttggtggactaaaggatacattcaaagaggtagaagaacaatctcgtcaaggcattgagagtatatcaagtacttttgaaactcagaacacagcaatcaaagaaatgttagctgcacaaaaggaattgcttgaaaatgagatctcaactcagcgcgaatcattaaagttacaattcgcaaatgtgccaagtcaaatgaacgagttggctaaagtaatggagaaactgaatcaaacaatactaactcaacaacaaaagattgatgagcaaggtaatgcaattcaaactctagcaagttctattggtacaccattggattctaaaggaaatactaagcgtaattggatgaatgtagcaattgctgttggcgtttgtggttcatttattatgcttcttgctatgctttgcgtccaagtgtttgatattaaaatctaacatgtatggcaaaaggaaataagaaatctttgttttggacaagctattcagatttgatgactagcttgttctttacattacttgtactctttgttgtagcgattattgcaatgggacgagcactcaaaaaagcaaatgatttacaaattgcaactcaagcagaaatcgataagattcataatattgaaaatagcatacaaaatattgatagtaaatggtttgagtacaatgaactgcataagaaacatgtgctaaagattgatgtctcgttcccaataggtcaatctgaaattactcatattccactagaaaaaagagaagaactatatagcgcaggcttagcaatagatcaattcctaaggcatgcagaagaagagtatggtgagtcggtaaagtatttgttaattattgaaggtcaagcctccaatgatggatttactggaaattttgatttgagttaccaaagggctttgtctttgtatcgctattttcaaattaaccgccatttggatttaaagcgacaaaattgtgaagtgctagtctgtggtagtggcacagaaggtgctttaagagcatatcctgataatgcttctaatactaaaaatcaaagatttctaatacatattttacccaagccgggggttattaactagtatgaaaaaaatatcagtattactaattgttttctgttgcgtcactttcattagctgccgtaaatctgcaagaaatcaaagagagcggtttagatcaaccgaaatagtaaccgaaagtgatagagatggttctcctacaaaagaagttcgagaaagacgaacgtcatcaagtcaaaaaagggaaaatagcaaacgttctaatcataaactagaaggttctcaagttttcgatagatatggtaatgctgtatttatgatttttacgagtgatggcagtaatgggtatcaaggctcaggtttctttgtgagtaacgatgggcttgccgttagtaactatcacgtatttaaagggactaccattggtagagaacagataaagttggctggcagtaataaatcgtattctgtagcaaaagtccttcataaaagtgaaaaagaggattttatcgtatttaaggtaaactgccaaaatacaaattacattccgatagcaaaatctaaacctaaaattggagataaagtctatgcaatcggtagtccacgaggattggaaaacactttctcttcaggagaagtttcacaatggcgtgcagataatttaatgcagataagcgcacttattgatcacggaagtagtggcggtgcactaatcaatgagtatggagaagccattggcatcacttccggttcttttgctgatggttctcaagctaatttaaattatgcttggagtatagatgttgtcaaaccatatatagaataaatccacatgaaaccgatattgaaacttataatcgccataatgctaattctttgcttagcagatatgccatatggcttctatgaattagtgagatttgcagcggcaggtacatttgtttatctatcatatgactattttaaaaataaaagagatggacttgggttcttatttgctggattagctcttttgtttcagccattcttcaaagttgcactcggaagagttctttggaatatcattgacttagtagtagctgtagctttgatatttcttctaataagaacctttaagaaaaaactatgacgaaggatggatacctgagagtttccgatgataagaagatcattacatatgtcgttgtcagtgataacaataccgaagaaacaagatttattcttgtaaaattcatcttctcgctgcttggctctttgtagcttctctatgcttctgcgcttttcctccgctgcattcaccttatgcagccagcggtcgtgttccgctttaaggtctttcagacagatgtacttcacgctgcgaatgtctttgcgtaagcattaactgaaatacaccttttagaggttgttatcgtgttgtaattttgccacgtgcaaagttgcaccgataacaccctttataattatgacaagattagaatttgaagaacttcagttaatgcttacgtctttgccacacttttcaagcaaacgtatggtgtcgcaccacatttcgtagtccttcggcacatagagctatctggtaggatgcccagcaagtatcaaggtaagcattcggtcaactacaggtattgaaccttgatctacaacaatagcgactgtcactatgaatccaatagttgcagtcgctattattttgttgaacctctatggctacagtcaacgttagttggaagattctccgttttgtttcgtcactacactttccggatgttgcaacttccatttgtatggaagttgttgtaagagttcctcgcggcttgcccttttaagataaggtattcaggcgatggtatcattcagataatcccttgggttgacatcgtggtgagccttgcaggtagcaagcagtgaacaaatgaccgacatgttagcagcagcttcgtggttgccgcagaaaaggtagtttttccggccaagggtgatagggcggatggcattttcagccggattgttatcccaaagcaaccgtccgtcctccagacatctcatcatgttgtcccatcgggtatatgtatatgaacaactttatagtggtattataaaaacactctttttcaaaagttgcaataattgggatttattgctgcttctgactataagtaaaggctatggctataagtatcaggacaatcaacacggagtatatgactattatttcagccaatatcccggtatgaagcagttttacgttggcgaaaactacaatcgcgaagaatgtggaaagaagtatcagcaacgcaaccatacaccagaatgttgtcggagtgaggggtatgcggctcgcattcctacgaatgtcattccccacccgctcgtgttccttgcggattttcgagacggcattgtcggcaatggcgtgtaactcattctgtaacgttttcttgtccgcatcggtcagcttgacaggtagggcggttttcaaaagttcaagcaggttgagtatggtttcggaaagcactccggatttctcgacaaggttgcatagttggttgtaagccctgccgatttccggtttgaggtctcggaactcgtttgccaacgcattattacgctgctcaagacgctggtgacgcaagatttctttattgtcattttcatcttgcgtaacatcgccttgtatcatatcattactgtaatcgaattttttgtttgccatagttcttcgcctatcgcctgattgatgatttgggtttctttccaagtttccttatggcggcacgggcgcatcttcgggcacgttccatttcgtcctcgtcctctttccgtccccacggcaaatcgttggaagttccgcctccgccaccggacgggacagccgggacactcatcatgccgacaaacagagccacggcatagtcggtaagctctttgtggttcaccatctcccgatagtcaaacttgtcatcgaataaccgcatgacatgatcggggagatagaaacggtaatccttgccttcatgcgcaagttcatatcttgatgttccttcacgccatgcggaatagtctataacaggcctgtcgcaagccgttgcaggttttgtgtcgggagttgttgctgtctgtgtttttatcttgttttcattctgcttcaattctgttacagacttgttgtgaagtttctgccatgtcgcttcaatcttcgaaaccatcaggttacggtctttgccgagttccgaagccttgtagatgacatccccgacaccgaccgtataaccgcgcaatacacctttcttgtcccgccgttcttcgagtgtgtagccttttgcccgtatctttgcgacataatcgtcccatgaccatgacggcattgaacgtaaaacttccataagtcctgctgcaacttcatcggcattcgtcctgcggatgtccattgccgtagtccaacctctctttcgggccacacgctccgccgcatactgtgcgcgtaaatgtatgttgtggtcattgttggttctgccttccttatccttgcggcagactgcggcgtgtagatgggggatgccactctttgattccaagtgcagccacacgctgtatatacttccggaaaggtttgtcttgtgggaatagatttcaccttgcctgttcctaaactctatacagtcatactcccggacaaagtcattccatagcttttcccagtctttcatggtaaagtgttccgtatgctcctttgccggactgatttcaatgcggataacgttcttgcctttcggtgcatgggctttcatcatgtcccatatgccttgcgcatcaagtctgcatggaagcaagttgtccttgacgtggtatatcagttcgggatacttcttattcctcgactctcctgtgatgtaccggatgttgtttatcccgtgactgatggattttgccttacctatcataactattcttctgtttctgttgttcttgtatttggggagtttccggaatccagttcggtgaaaaatggctgtcaatcaactttgtaaccacttttgctgtcctgccgagcagttgcaatgcaccgaccatccacgtctggttgcggaacatcgcacgtcgttcctcctgcggcatggcgttgagcatggacgtgtatctggcgtaatcgctccgtgccatgatgagttcgtcacgtactgcctcctgtcttggggtcagtcgcgctttgggtctataattgtacgaccgtgccagcacatagtcgctgagggtcatgccgcacttgtcggccaaccttccgatatgttcccgttgcgtcttactgacacggaacgagatggtcgaatcacgcctttcccgtttagttccagtacttttggtatcttcggtttgctgtgctgtttcctgttctctatccataaaaaaggggttaaagtgatacaataggtatgttacggtgcgagcctgcgagcggcgttccccattgtccccgtcggacaatggcaagggtgccgtgtatggaatgaccgccagggagtgtaatacatcggcatatcttgtaataggatgccattccctgcttccccaatacggttcaccctgctggatggatgtccacaaataccttacggaatctgtcggctgtgtataaaaggatggggggtgcaacaaatggtttcggcattgttgtcggttatccctacaagccgttgcagcttctgccgctgttccttgtcggggctgccgacatctttgcagggaaacgacatcggagtatcggacatttctgttccccttatttcgcaaaagttcacagagggtggttcttgactgccaacactccgattgccttgttgtcaactcctgcccgcagtagtgggaggttgtgattgcaagtgttgtcgtgcatcctccacggccttgaagtccgatgagattttcatcagtgcgacactgacacggcatagctggccgatgttgacgaactccttgacggcttccatcagcttctgcgcacgttcctgccggtgtctcattacagtttcattgcttgttccgttttcctttataagcccgtggttgagaaagcggtttacggcaagctggtcggttgcctcaatcgtttcggtatcacccttgccggtggcataaccgaccatcacacggatggaatccgcctcgtaaggcgtgcagcgtcggagaaaatccagaatggtctgcgctttcgctccgatggcggagcgtgtcgtctttgtcttggtttccttgtttgtggaatcctgcggtacggtattcctgatgcctgtaccggtcatgtttgaatcgttcatactgtttctgtttttataagtggataaatcatttgtccttctcacggtttgccagataccgtgaagtctcgctgtctatctcgtcctgcgactttacccttacccgtttcagccaggcatcaaggtcttcctttgcgaagaagcacagcttgcctcccggcttgtagtaagggattgcgcggcgcatcatcatcttgtagagatagctcggtttcactccgagataccgggccgcttcggtggtggtcattaagttgcgttcattctccatgtcacttgtccttttattgtttcaactgtctttcaaatcctgtcacaacggtgtggaacacattggcatttagccttttgttgccttccgtttcgtttgcaaagttactttggactcaaaaggggacaatgtggggcgaatggggaaagtgcataaaagcggcagtgcaccatactgctggcattcaacagtatggcgcactgccatgataggaaaatgttatctcaaatgggggactggcgggcagttacggggtgtttctaaaccttctcgcgttttcgatagccttgtcaacggatttgcggtattcacggttctcttctgtcgtacccttgccgcatacatcactgcggtgcttgtcgtagtatgacttggatatgccgcagcgtttcagaaactcttccgcccaaagtttgccacgctcacgcggcctgatggtctgcgagacggaaaacaccatgtagcagacacgcaggttctctttcgggcgcacggcaacagcccgtgatgtgggtttcaggttcatgaagttcacgaagtcgctgcccgacacgtactcgaactgacagtcgttgcacacctcgtagatgaacaggcacagggcgaggtcaacggtgtccatccatgcggatgtctcctgcaacaggtctgtccgggtcatggctcgtcctccttcatgcggctgatgtcggcaatgatactttccgcgatacctttcaggcgttccaccagaacgtcaaggaacatcggcttgaaacagtacacatagaaataccggtcacgctcctgctgccactcgttatataagaggttcacgcgcgcatgagcctcgtcatattctgtttttgccgtatcgcattccgcatcaagtgacttgtattcgtcggactccagcggcaggaagtccagctggttgctcaccgcagaatagttctgccacaaaattgtggcggtttccttggcttcttcgtatctacgctcaaacggcctgaggtgttcttcaaaaaacgctttgaaatccacggtctgcaataccgacctgtcaagcgacaggtatctgttcgtttccgaaataagggaggatgaaagttccgacagttgtccgggattctcctttgccaagagggtggccccacctacaaggctgtttgtatcgctgaaatcacgatagaacagggataatgtcaaagcctgggcaaaagagaaatcgtcttgcctacaagtggtgagaagtgtgtttacctcactcagccgttgtataatttgctgtatcatcataattgtcaggaattgaaaagggcatccattgtcacctcgctgtggacgatgctcttgtgcttgccattggcaacgccataagtggttataaatgtatgtactaatgattttttatttgcggtcaaatatttgaataagcccattctttctcgaagttttttctcgtagtcttgggagatatgataaactccttccgagaatttcatttcgcaaagatgaatcatacggtccgcacgttcaataatcatatctatttgcgctcccggagtctgttctttctcatttggtttgcaatgccatgtggaaaccgatgtggccattcccgatatgcccaatgctttttttatctggttgtgatgccgcaggcagacaagctcgaaacttactcccatccatgacgtgacgctttgcgaatcaaagttattgctccaccattgttcatccttggtgttgttcgatttgataaacttataataaaacaaagtgtagaagtccgtaagacgaagtatttcctgccgtttcttgttgccatattgagaccatctttcgataaagtcacaacgctcaagatttttaagtacacgggtcaacttacctccttccagtttgatttcctttgcgatttcctgaaatgtcaatcccgacttatgcgcactcaacaccttgacggtatcaatatagtaatccgcatttgagaacaaggcgttgtacagttcatcaaattctatccgcaatttgccatcgggtctgaaacagagaaggtcgatgttctgcatcaggctcttttccggtgccagtatactataataataaggtactccgcctaacagcatataagattgcaatatctgatacctgtcccagaacatccctcgattttccagatatttctccgtttcacgcaacgtaaaaggtgcaagatgcagctggcatgtgacccgggcatgaagtccgcccttgtttccaaccaatttgtccctcatccaagaagtggcagaacctgtggcaatcatcatcacattttcgcggctcatcgcccagccattccagaaattttccaatgcaactacgaaattggagcggcctgaatccatccacggcatttcatcaatgaacacaattctcttcctgtccgcaggcagatgctccagataatcctgcaatgcgtcaaaagcatcaaaccagtctgaaaagtggtagcttgaaatgccggaatactctttgaggactttggcgaacctccgcaactggtttttggttgtcagcccacgtaccccgacaaaccagaagtcgaagtgcttttcaaaatattgctctataaggaatgtcttgcctatgcgacgacggccatatactatgataagttccgaacggtctgattccagacagcgttcgagttcaccacattcatattcacggcctatgagtttttctgtcatatttctttgttttgttgcaaagttaacggttatatttgattcaaccaattattttgcccacaaacaagactttatcatgcgtatttattcataagaagtccaatgaaagggcaaaatctgtataaaaaaccactcaatagactttatgtttattttcagggcagataaagtcaatcgtacagagccgttcttatatgacagaaggattggagcggaacatactatttaagacaaaaaatgagctgaaaacagacctaaaacagcaaacgtgatgttaatcaggtctattttcggactaaaatagtttgtccaatgccgaagttattcattgcattttatcagtcagattccatctgctcgaacattttgtcaaccatattgacagcctcaatcttcttgctgtcaacgattttcgcgtatatctgcgtagtgcgcacgtcggcatgtcccatcagcttgcaggtcgtataaaggtcagcccccacggtcatcatcatcgttccgaaggtatggcggcttgtgtggtaggtgattttcttgtcgataccggccttctccacccattgtttgaggattttgttggtggtcgggcgtgacggaagttccgcgaaaacaaacgtctcgtcactgtcgtccgctttccgctcaggcagccacttgactgcattttgcgagagcggcgtataaatgggggtggatgtcttctgttgcacggtggcaatcatatacctgccgtcattgcatataatgtctttccagcaaagggtttccatgtcgctcaggcgcagtccgcaatagcaagagaacaagtaggcttgttttactgttctgttacggcattcggtggctataaggagcttcacttcctcgatggcaaggaactggcgttttgattccggtttctttacacgttccgaagccgagagcagcatgaacggattttcacccagccattccgcacggacagcggcattcagagcaatggagagttgggagatataggccacgactgttccctgttccagcagtttttcctgtctgcctttataagtgtgttggagccaatcaatgaaaccgagtgcccacttcttgtcaatgtcgcccatccgggtacttttgccgtattggttgatgacctttataatgcttctcaatttgtcgatacgcttgatacccttgcgctcctggttggaatagaatttttccagccagtccgccaacatcagtttctgccatgcgaacttgttcctgattccggctctggaatttgtaatctcgatgatgcgctgcgactttatggtctcgacagcctcacgggtggcgcggttctgctccctgaccctcgcgttgacttccggcaggtggtacatcttcagaaactcataactccgcttgccgttgacatagatgtcaaggtagtacgattcggaaccgtccgcaagtttctttgtacggactcttacaggctctttcagtttgcttgattttttatttgtcactgccatgtcttaaaatactttgtctatcagtgaaacggcctcttcttttttcctgtcaacgatttttgcgtaaacctgcgtggggcgcacatcggcatgtcccatcatcttgctggcggtataaaggtcaaccccggcggttatcagcattgttccgtaggtatggcggctcaggtgaaaatgaaggtgtctgtccagccctgccagttccgcccatttacgtaaatgcttgttcaggacggtatgggacggaagcgagaataccgatgcctccggttctccccgctcaggaagccacgataacgccttggcgggaagaggaagcgatatgggtttggagtttttctgcatcaccaccgatacgaagtgttgcccgccattgacggatatgtcactccagcacaagtccgtaacatcgcctacacgcaatccgcaatagcaggtaaacagaaatgccctgcgtatattctccttgatatagggggtgtcctccagtttgcggacttcgtcaagggtcaggaactcacgcttgctttccggtctcgctatcttttccttggcgctcagcagtttccaaggattgttctttatataccctttctgccaggcagcggacaggatgatgccgagaatccagaaacaggaacaggcggtggcttgggcgagcggctttccttgcggagtgagaggttcggattgaagccactcggcataatcggtacagaatctcttgtttatgtcacacaatcttgtaccggggcggaacttctcgaatttggtacgtgatgcccttaaatgcagatgtgcgggctgttcccgttgcttgtattcctccatcaacaggccaatgaagtcggacaacaacatcttggacttgtctttggctgcttcctcctgtgccttgtcatcaaccatgttttcggtcttggcaatgatgagttcctccgcctgacggagcgtttttgcattttcacgtttcgccttgacggaattttccggtacaagatacaatttaaggaactcgtattcgtgcttgccgtcaaccgtgcggtctataaaaagggactcacggccgtccgtaagttttcttctccgcagcttgaacggacttttgtctacttttgattgcttttttctacccattgtgctccagtgttttatattcttgtgcaaatatagtaaatcggtttgatataagtatcgaaacaggtaacaaaaataattcaaaaatgggtataaatggaatctcacaggaatagataagaaaacaagctttattttataacacacagatatacaataatataaattcttatttatagaaatattaccctttcatttctctttgattacagatatttatccttttccctctttccgaacacctgtctcaaacagattcttaaacgattctaccgacaatgaagtggacggtttaaaatctgaagaattcatatacgccagcaaagcggcatagaattgtaatccttccggtgtgtcacgtaccgcttccaagtcggacatacaaagcagtaatttactgccctctacattcaactccatcaataagccgagtttatgatttcgttccacattgtcaattacctgcacaatagggcggtattcttttggcataccatccagaataagcggatagctatgtttgataattggataccactgccagttcgtatggtattcggtcgggaaatcatcgaataccggatgctcgggattggtcagaatccccaatgtaccaggtgaagcaggtttcttgatgcggtcacagatacttttgaacatacgataattccaatagtcggtctggaacaatcctcccactgttacttctttacagtcttcctcacgaggcatcaacaatacctttccaccttgctttaaggcattcagcacatcatccgttagttggcgggcaactacaacattacctgccttcaattgcttctttgcaggatatatccatagcggataactattctgataggaagttccggatactttcaaaagtaattcggctttatacgcttgctccacatcgggcaatgtcaaacgaatagttccggcagtcaataatcctaatcccgatggaatagccatcttacctttgccaaggcttttcttcccatttttgagttcccatgaaatacttttttcgttcaatgaagtttctccataattggcaatctcaacagtacctgcgaatgattcaccgcctgtccaacagaatttggcagttgtcaataaaggaaccacttcactacagaattctctccatttcttcggttcaaccaatcctttactatccataaaagcatccagaataccaacataagccgacccctgtcccggataatcctgtaaatcgagtaactgaaaaccagccatccgtttggaacggagattcatttcaatatctgcccggtaaagttccacagaccatgcacccgatgctttaaaaaaatcatccgcctgctccagcatgccggctttctccaagcggtcacgaaacacttcaaaattccagggagctaagactcctgtatatttcttcatctcctcataattcgggtaagtttgaaactgtccggtttcatgtccgatcaccggaacaggagatttttccagagcctcatcaaagttcattaccgaattaggataggtattattaagatagccaccttcttccgcatctgcgaaagagaaagaagcacgagcatgagtagaataaccctcaccactgcctacacgacaagttaccagaaaatcctcacccggaatatgtcctcgtgagcctaaaaagatattcgaaccatacgtgtataggtgtctcggctctatggaccggaaacaatctacaaactctttcatcacatcgatgtcacctcccagctcatttcccaaggcaaagagtacaaaagaagcatggttactatattcacgcatgatattctctccatctttcatcagaaaatccatcagctcggcagattctttcttaaaccctccccagataggtaattccggctgcaagtaaataccctccaagtccgcagcttcaaaacacgcagcaggtgggcaccaagaatgaaaacgacaatgattcaatccatattccttacaaatcctgaaataacgacgccattgttccaagtccatcgccgtatggcccgtcaaagggaatacacaggcatcatgttttcctcgaagaaatgttttggcgccattgatagtgaaatgcgtttcttcagttttaaagtcacgcaaaccgaaacgaactgttttctcgtctatgccatttatctctgctttcagttgatatagagccggctggaggtcactccacaatacagcattatctcccaactgataagtgaattcatattccttgctcccctctttcaaattatattctgcagatctggctttatgctttttggcagtattgaaagcagaagctgacaactgcagtttcttcccaccaatgcctgaagaattggaaagagttattttcacttttacggagcggtcttctacttgaggaaaagcctgaatggactcaataaacaatggattcattgcctgcaattccatccgtccgataataccgttccagtttgtctgggtagattccgtacaagcgtgagaacttgaacgaatctgcccgggaatactttttccgttatctacacgaatagtcagcttatgtgaaccgggagccaggaagtgagtgagattaaattcctgtggggtagataaatagttgcatttacccacttcccgaccatcgatccacacggttgtcggacgagtacgttccagaaacaacacgatatgcttttctttccagtcggctggtatttctatattcctgctataccatgccgcaccttcatatttataatatctggacaaataagtggtctccgacttgttggtattctctattccttttcgatttgaatctgttgtaccgggtaaagtcacagtttctgcaaaatccatgttccacagtttttcctgttctcccttgccgtgagggtccaatgcaaaactccacgttccgctcaaatcaatcattttgcgcaaacctgatgtctgcgcccatgatgtacacaaaaaaacaaataataataaaagagttccagctaatcgattacgcataactttattcataatatatgatttaatgtccttaatttatctgtttacaaagataggacggagaacaaaccacaatgacaaatcccgtacaaaaaaacaataatatcgtaaaagatactgtgtatcatctcttttatatcactatcagcatgataatgtccttgcctgactgataaaatacacaaatagttttttcatagcttcatccccttccacagcctgcaactctgggtggaactgaacaccccaaatatgttcggaatcagattcgattgattctatgactccatcatcagcgaaagcagatgccttgaatccacaagccaatttcttaacggcttgatgatgaatggaggagactttcaaactttccttgcctgtaacagaatacaattttccggtcctcaaacatcgcacattatgctgtaatatcataaacgcatccggtgaccgatgattaatttccgagggatattgagcaggcaaatcctgatataatgttccaccaaaataagtattaataatctgcattccccgacaaatacctaaaacgggaatttgcctttcggatgctaagcgcagcaaagcataatcaaagtcatccctatcccggcaacattctccacattcaggaagagtcgattctccgtatatcacaggcgatatatctcccccacctgtcaggagtaaaccatcaataaaagaaaccacagattataaaatctgtacattgtcggtaaacggaagaataaaagggatgccgcccgcttgaaggacagcatccacatattttcttttcacagatattcttcccggaatatcaatttcagtagaaataccaataacaggaatttctctttttatcattctcattgtcttttatcaacttaatccacagcctgtagttgtaaagccaaacttgaatattcacttttcagcaatgattttaatgcaatgccttcttccatcaatatctttccactaatgattttaccattcaggtcacaaggtttgctactgtccacaggtgtcaaatctaccaaacgataattcttcgacggatccaatccattcatacaaaccttcggaataaccatattgatgaaatgagaaatcttatatgcataaaagaccgccttattcttttcggaagtgacatacatcagagaggatactcctttattatcgtatggagacaccaaccgatacaaatcaccgaactgaaccacaggacgaatatctttatacgctgcaatagcacgcttggcgaatgccttatcaacatcattcatgtccttcggctgaatttccattcccaatcgcccggacattgccacatcaaaacggaatttcaatggaatacggcgtccggtctgatgattcttgtccgcacttacgtgagatgccatagcaatagccggaaagaaaccggaaactccccattgcatataaattctttgcaaagcatccgtatcatcactcgtccagaactcatcaaaatacggaagcaatccataattgacgcggacaccgccaccagcacatagctgcatcacgagttcaggatacttagcacgaatacgctgaagtactttctgcaaacccctattatactcaatatagagatgtgattgcttgttttttggtaagtaagaagaaccataatccagcaaactgcaattatcatcccatttcatataggaaatttccggatagttcgtcatcaaattatcgaccactccaaaaacaaaatcctgtactttcggattagtcaaatccagaactacctgcgttttgccacgcccggtagataaaggacggttatcaattttcagaatccagtccgggtgcttttcgaacagttcgctcttagtattcgacatttccggttcaatccagataccgaattttatatgatgcttcctggcagacgcaagcaatccttcaataccttcaggcagtttttctttgcagacttcccaatcacccaaactactgtttccaccattacggggatatttatttccaaaccagccatcgtccatgacaaacaactctccacccatggcagagaaagcttccatcatctcatccatccctttttggttcaccttgaaataaacaccttcccagctattcaacaagatgtcatgcagcctttcaccctgattcattttatattggcgtgcccaatgatgaaaagcacgactcaccccacctttgccattggtactatatgtcatggcaaattcaggagtgacgaatgtttctttcagttccaatatgtattgtgaactttcctcattcataccgactattatattcagtgctgtgttgcgaacatccagcttcaacttataattaccactccaagccagaacgcccccaaacacttttcctgattcttcctgcggtctgccatccaatgataacataaaagacggattatcagtttccgtattcgcaagtccatctttgttggcaatcactttttgcccgttcgtcagtttctcttcatccatcgtatgttccgcgccccacgaaccatgaaaatgagtcagccagttgtccctgcgagacatcggcaaataagcggaagcaaactgaaacagtgttaccggtttcttacctgcattgccaatctcaacccaagtggtaattatatccgttcctttataagccttatagcattgtttcacccaaacaggatatatcttatctttcaaaagcacttccaaaatctcaccatcgtcaatcccgtattgctttacattatctactcccaaatccaatgacatattgccgtcggcatgggtaattgcgaccgccttttcgcctacggtctgaagaccgaatgctggataactatccgcttcgaaagccaaaccggcatcataaatattctggatctgaacgggagtgatgctcactccataatattgcatttttgacttttcaccctcattggccgtaatcaacaatgaggtccgaggagtggaaatcaagtaatcttttgacaacaatggagctgatatcaacagccccattgccatcattaaacccatctttttattcatggctttattgatttaattcattgtatcgtaaacaatacctatagaaaacgttgtaaactaacgatctttttacccttaaaattcaacttttatttcacagacatccttacctgtttccaaatgttgtctctgtaactctacatccggtaaccatacatatttcttctgtgccgcatcatctatcacctccactaggaaactgaaccaataagagtaaggaaataagtcctgcggttccttaggcggaatattggggtcagtcatatcgggatgatacagtttatacagattggtcagttctacttttccttttttatccgtctgataagtcctgtacacctttgggtatacatcacgcttattatatttaccaccggcacgtgtaccatagaaattcacagtatagttggatttcgcctttccattcttttctaccttaatcaccagtttacgcggaaatacctgatctgacaagtccttatcgagcggcttcatcttcgccgtataattgaacaattccgagcaataatcactccatacacgatagcccgtccccatattgcatttagatggagtcagtttctcgtggctcacaggattgtcttctgcggcaatcatatactgatataaatccgtagcaccacgcatatgaccatattcatgtcctagattgctatacgttccctgattgggataaagcgcatccgtaaagatattatgaggttcgcgaatataacacatcactacagattgcccactcgctccacctcccccacaggaaagcccttcattctttgcacccaacgccaagaacaacacaaaatcatatttcgacaaatccaatggtccataagccttattcttaaattcatcatatttgtttttgtctccctgaatgtcgtagacgtacaattcttcagcaggaacaaagcgaaaataatgattgaatttattaggactttcattccaaaaacgcgtagtattatgaaacatctttttcaagttcttcttgaaatcctcttctccaccataacgttccaggtctgttttatcaacccatacctgggcacgatattctattgtatctttcgcaatcggagattgagcatgagctgccccaatcaggcagctacatgcaatcagtagatattttaaaatattcatgctaaacttattataactgtatttcaaacacataaggttcttgctgcccgccatccagatattcaggaacaatatccaaatccgacaaccacacacatttcgtctgtccaccatccaactcgacttctactacaaaacaataccagcgtgaaaaaggaaattcatcaaccggactcttagggggaagattcggagtattattataatccggaataaacatccgatatatatcattaatggtaaattcaccgtttgcatctgtttttttcttcatatatggagaattgcccggttctgcatatatatccttaaaagtggcacgtgagccccaaaaattgactgtggcacgttgtaccggtttaccatcttttgttaccctgaccaacatctgcttaggatacgtacttcgggtcatatcagcagtaatttgtttatattgggcattatggttaaatatcgccgaacaataatcactccattcctgataacccgtccccatattacacttaggataatcataagcaacatgactgaccggattgttttcagccggaatcatatactgatataaatcctgcgcaccacgaacatgaccatattcatgacctaaatcactgtatgtacctttttccggccatttctttgcaaaaatatcatgcccttcctcaaaataggcctgtacaactgactgcttacttgctccgccaccgccacaagagagtccaccttttgtacaacgtaaagccagaaagagaacaaaatcatacttctctgtattcaaagtaccataagccttatctttatacacattgtattccgcctggctttttacaccactttttatatcgtaaataaccaaattgtcatctccttcacccatagcccattcaaagcgataatcaaacttgttcgtactttcattccaaaaagtagtcgtattgcggaacaacgcttccagattctgtcggaacaaacgttctccgccatataattcttccatatcgtttttctctacccatacttgtgcacgataggtaatcgtttctcctgcctgcggtctatccggtttctcttctgtaataagtcccggattcgttatatcaatttcgagatcacacgcagccagtgtgaacaggctgcatgcgattaatgtatatttttttaaattcttcatcataactcatttgtttttatcattcaactgtcgttctatccgaagcaaagacttcatccaaagaaacactctttccgacaccttggaaactttcatataaatacaaacgaacataccgtttatgtactactccattgagtttacaccaatgaacaatgccttcataatggtcattatatgtatttgtgctacctttcaattctgcatctgtaaaacagtttccagtcttcttttcaaatgcagtttcccaaccagcatttaagtcatcgctaacttcaatagctacagttttaggagcttgttgtgtccactgtaatcttggcataaatccgaaggaatcatattgacgaggattctcacctaaatcaaaagtcaaaatataaggcacagcagcatgatcatcattattatttcttccccaaaattcaacatgcttctcatttgccttatcgggagtccaaagattgtcgaacaacttattagccgaaccgtcattatattgcgtattggtattctcactatgtgccactatcttccataacgacttgctcagaacaatcccatatccagccattccttgtttcagagataccttagtttctacgcttgtcttcgtattctttaccccaatttctgtcttacgttccgtattggtgctttcatttttttgaacttttgcataaatcttgccttcttcctgactcaattccaaccaagaagtatttcctttcaactccaagtctgtcggatttatattctcacaagtagctacaaggagtttttcattcgcatccgaagatataatgagctcacgttcctgttgataatactcctcattccaaataatcttctcaacaccaaactggattatctttaccgtcttttgagaagttacatctccagcagtagctgtaaaattaaccaatacttcgcgatatacattcgctgtattttctttgattgtcaaagccagcgttttaacttccgaacccaaaactgattctaccggagcttccgtaagtatcacccaaccagtctgttctacatcaggataggttacatctatcaccggagaagtagtgccctggtaagtcaagatgttcagttcccgttctcccgctgctgtaaagtctttaggtagagtcacatcgaaagagccatcagctttcgttgtaataaatacatccttcggaaaactactttcatcaatagtaccgacaagcaagagttcatccacatttccttgaatcacagtaattgttttttttaccggaatttctccttttgtggaaatcacaacagaagctttacggtctttcgctgttttattgtcagcaatgaccaacgataatgaagcagagccctcaccaccttctgccgaaggagtgatccatttttcttcttcagtcgtcatatagttgactgcaacttcccatgccttatcagtctgaatttccagttttacagttcctttatattcagttggcaaagtcactttccagtgtccgtctccagcttcctccaaagtttcattgcatgatacggtcaacgcatcaggtgtccagtccacctctttctcatcattacaagcctgcaaacagagcagacacgatagtagtaaaaatatgttcctcataaatatattgtttttactatttctatattccattattttttagagacaaatatttcatcgaagcagtgtgtactataccatgaatcccacatagacaatcgtatataccgatgatgcatattttcacccaaatcatgccattttacaaactgtttatcagcgtaccaatcattccagttaccaccatcgtgagcatccaattccgttttcgtgaatgcgtcccttttagcactgccaacaagaatccaatttgtaatatcttcactacgtgtcaacacctcgtcactaacttcgatcttcaggtatttaggtgaatttcctacccattggagtctcggtatcaatccgatcgaattatattcatgaggattctcacctaaatcaaatacgatctgtaccggattctcttccgaccctttatcacttatctcgatgtatgacaaagtgcttccggaacctacctccgccttacttgtcggccagaaattatcaaatagtctgcctaatacagattcttttccggagacatgttcactatagcctaccacactccacaaagatttattcagagtaatgccgtatcccttcattccttgtctcacaacaatctctttttcaagccaggtttcattgtctacgagtgtaatcgttgcaacacgttccttccatgtcgaagtatttgcactgctcacagtaatctgaagtttaccgcttgcctcattcacctgcagccaagtgggttcatcaccatatttatctgctacggaataagataaatcgctgatctgacttacatcagcaattacttcgcgggatggtgtattatccgaagaaagaataatatcacttccttgcacataagttccttccaattcaacctttgaatccagtgaacctttgacaaccgtcaattttatccaattctcttccgcgtcagaaccaactttatcattcgttgttcccacacgtaccggaagtatccattttccgtcctgcatttccgacggtttcagggtcagataattctctgcatatttctcgccaaccggaatcttcacgctctgtgcatattcaaaaccagcagtcagcaaatgagatttctcttcttctgtcaacagattatccgcttctttatcataaccataggtaacaaccagctcttccgtcgtattgatatccaatttagctgtaatatctatctgacgctctgttgtcgctttagataaatccataaagacttctcctctttgttctcctgcggcaccgtcaatcaccagtaccggctttctgatatccaaaagcagaataaagtgagatttatctacataaacatcctcttctggcgtacggctattgacagacaaaggaatataataaataccataacctttatcctgaagaagctgttctatcttcagactcaatggcacagctgcctcatccgctccggcttcgataacgaaatcacgttcgagcgagtaatacttttcatccaacatctcgtaatcagtgccgttctctgtattatactgaaccagataattataatccagctctacccttccggcaaatctattctgatagtaacccgccttatgaatccaaacgttgtatacataatcattggcattcatcacgtaaagggtttctttctgtaaatcactcttagggaaatatgcagtatctcccatcatgtaatcagttctagtatcggtacaagaagtccccaataaaagagccgcaaataaaaaacttatatatttcttcattgttaccatcttttttaccatttatagttttgtactaaatcttggtttttattaatcgcactttgcgggatagggaacagatagaaactcggtgtaaacacacgtttctctaccactgtacgctggaagaaatccaccggatattcttctttgccgggagtacccttagcctggatattcataccgtgaatatttcctttttctgtagcttccgcagtcagccagcgacgacagtcatagaagttgatgccctcgaaagccagttctacgcgacgttcgcgatgaatcaagtctctcaacttatcctgatcgttcatagcttcaggatatgcatcttcgatatcattcaatccggcacggttacgaatcgcattccagaaagtaaacaagttcggatctttcaaatcacctacctcgatagtagcctccacatagttcagcaggatttcagcgtaacgcatataaggtaattcacgttttacgttcttcgttgggctggcttcatattccggcatagccagttttgccaggttatatcctgttgtaaagtggttatgagaagcatccggaccattatttccattcttatacatctccaggaaaattctctcacctgctttctttggaataaaccaggacataccgccatacactatcgacacatagaaacgaggttcacgacccacaaacatattataagtctttctctccttaccttcacatggatttgtaaattgagaatatccagcttctttgtatccagcctccggatctataaccggcgtggtgcgatcttcattcgtgtatccggtaattgggaaacgaccggtttcagccatcgcatatgcatcgacaatctcttgggtaggattatagcctcctccccagccaccattactgttaggagcaagacgcttatcaataccgccaccatcttcgaggtaagagaaaatcatttctttattctgtgaagtggtaaatacagatttataagaggtataagggtctattttacccatattagctccactttcataattcactttgaccaattcataattaccatcctttataaggctcagagcagcctggcgagccaattcccatttattcttgtcatacgttgtcgggaataacggagttccgtccgcattgcggatattattatatttcggattaccattgaattgtggactggctgattgcaacagaatgcgtgccagataagccttagcaattccccggttcattcgagcataagtctcaccctctgactttaaaggtaaaggagaattttctatcaaatccgtaaactcttctgtaatccattgcacacattcatcccaagtattacgttcacgaaacatatccgtaccggagaaatccggttgttcgtccttcaataaaatgaccggaccgtacatacgcatcaattgtgcataataataagcacgcacacagcgcacttcagctttccactgctcacgagtatcataagtcaggcgaggatccggacacttatctacattctgcaggaaataagttgcttcacgaatggctttgtagaaagtataccatctatcatactgtgcagacgaagcactccacactcccatatcaaaagtatgcgtatttgtataagccacatccacatcactagtactatatgtatccggcatatcaaaaggataagtgccacgaatataagaatatactccaaacattgcgttctgtgtagacgagtaagtctcataaatctgttccggagagcgcaaatcctcgggagacgtatccaaaaacgaatcacaagatgacatagtcaagactgcggtagccaaaagcataatacgtttcatatatttggatttcataataaacatgtcttttagtattagaaattaatatttaaacctacattaaatacacgtgtcggcggatactttcttccgtcaccggaacccagatccgggtcgaacagatgcacatccggtgcccaagtcaacaagtttactcctgatacatacaggcgtaaattctgtatagccatcttttccatccatctcttcgggaaggtatagcctatctccgcattcttcagacgaaggaaagcggcattacgtacccagaatgatgatttcttcgtattgttattatccaaagcgtcactcggacggatcgtgcgcggataacgcgcattcgggtcaggattgtccaccgtccagcggttttccatcactcctctcaagaatccgtcattattcttataaccggaagagaagggtacaatagtagaaccttcttcaaacagtgacacacgggctgtaccctgaaagaagatagaaacatcaaaacccttccattcgatagcaccaccaaagccataagtaatctccggaatatcacagaatccgataggcattttgtcataatcatcaataacaccatcaccattcagatcgcgatatttaatatcacccggacgcaaacgactatgattaccttcactgaactgtatcggactgcgatcgatttcttcctgtgattcgaacaatccaacggcctcccatccgaatttctgataaattttctgtcctacggaattcatccaaggatacttgttcaacgcatctccattgcgaagaatttcattatttgcataagtaaacgtaccacgtccggttatattcacctgaccgattctatcacgatactctaacgaaccatcaaatccccagcttttcatcttacctacattcaccatcggtacggtagtcataccgacataagccgggatattattattgcgtacaaagatatgatcgcgtacatcatgataccagtcaccctgaatttccagtttattgaacaagcctagttcaaaaccatagttctgtttggttgagacttcccaacctacatttgggttggctacttcattaacacgctcaccacttgtcttcgaataattgccatatacataatcattagtagtagatacagttcctaaatagatgaaacgaacatctccaccaatctggtcgttacccacttgtccgacagatgctttcaatttcaactttgaaacgacgtctgtcaatggcgagaagaacttttcattggatatataccatccgacagctaccgccgggaaaaaaccgacacgatgaccggctgcaaagttctcggaaccattgtaaccgaagtttccttcaataaaatagcgactatcgtaatcataagtcagacgtccggctataccctgatttttataaggcaatgacttgatagatgatatattatccttataatccttattccggtaggtttcattcttaacacgttgattatacaggaacaaagcacccacacgatgttttccaaataagcgattatacgtaatagaagcctccagataagtagcattattaccacctgacttattaccaaaccatggacctcctttggcactttccggttcagagttgaataccagatcgccatttgcgtcacgacgtacagcatgccaaatttcatcctgctgtgtatatttattgccatgccatgcctgcgtatcgaatgcaaacttaacattggctttcaatccttcagtaataaaagaaaagtcctggtccagactgaccattgagttgagtgtactttgccagtcttctacataccctgctctggttacctgccaataaggattggtaacccctttctctccaccccagtaaccgttggagtattgaataggaaaagcattaggattcagaatgaaagcacttttccaaacaccatccgagtcggcagcatctctcctttttgtgagaaatcctcctaaagtcaatgaaagaacagtagtgggatgtaggtttatatccacattcgaacggaaattatagcgctgataatcaggattaccattataggagtttccctttccggtcataaacaggccatcttcatgataatagccggcagaaataaagtagcgtgcaatttcaccaccaccactcacattggcagtgacacgttgattgaacgtatgtttcttgaaaacagacttcagccagttcacattcggatacaagtctccgtctgtatgatttctatatttttcaatatcactttggctataagttcccggcacagcctcattatacatattggcaaaatccacagcatccgccatttcaggaattttggtaggagctaccatacccgcttccattttgatggagattttcggcttaccttcagaaccacgttttgttttaatcaatacaacaccatttgcaccgcgtacaccgtaaagagcagtagcagtagcatctttcaataaagaaaaactttcaatttcttccggatcaagcaggtcgagcgagcgctctacaccgtcaacaagaatcagaggtgtcttattcgcaccaaaagtagaaataccacgaatccaaaattctgccgagctacccggagaaccatcacgctgaatagaaacaacgcctcctaactgaccagccagattggtagatatagaagcactgggaactttcagattactaacactcaatgtactgatagaaccaatcacactttctttacgttgcgtaccgtaacctactacctgcacttcttcaagcactgtatcatcggtactcatttcaataagcaaattatttgccgaaggggatatctccttttctatattagcatatcccaaatagctgattaccaatgttacggtcttaccccccggaacgttgatattgaaattaccatccatatccgtagtacctccgatactagtatctttcaaccacacactagcaccgataagagtctccttcgtattcttatctataatcttacctgttaattttctagtagcagccttcttcccttcctggaatacttcagtcactgcacctgacgcatacgtcgaagcaaaaggtgccgcaaaaaaataaatgatgataagagcactaaccaatcgtcgtaatgagaaatctaacttacgtgcaatttcattcataatacatgatttaatgttattaatttaagtttgagatgttttagattgttgcaaccaaattctaaagtaacgttcacaaagataaacgagaaaataaattttccaggcgaatcccgtacaaaagaacaagaatatcgtaaagctatacttttttttcgcacgcatacagcctcctcaccaattattatccaagccttgaactattttatccaaactccatatttaagtgcttctattatcaataagtgccttaccccaattagcatcccaatggaattaaactaattgaagtaaggcatcttacactaagcgactgcttactgcaggatttataaaccccagatatcttctatcgacgaacccgctatttatctttcattttagcaaagagaaccacattatttcccccttcatccaatgatttcactaatgtttggatacgtttccgcacatcgttcggaagatctttccgggccaattctttttccaatgtttcttttaattgggcaggttccatattgttaatataatagccattggcaaacgagggccatatctgcatcttcttcgttcccaggaaatcattatataagcggaaatagttgccgtgcagggtttgtttgtcaacgatatatttggcaggtctacttccactccaggtatttgctgacacttgtaccggaacagaaacatcgctaacgaagtgacgtggatattcagtatagccatgccatgggatttcttccttgttcggataactcactgtgaaccgggcttcaagcctgttttgttgtgaattataatgatcaaactatctacccgcggagaaggcacgatagtcatcagcataacgctgtaatcggaagtattcttatccataaaaacttcattactgaaatcacggaaccatcagatgtagggcaggaataaaatttttgcgtttaccttcaaagtcctgtgtccatactacagccggagtaccttggaaaggtagcgtcgtcaccgttacttccgacttctttgtgtcgactttgaattgtcctttagggacacgcaaacacaaagggatggaaggttgagggtttcctttcaagtcgaataccaatagcttattactctgccagggtaagatatagatacggtcatgcgcttcatccaattgctcggcataggtattggcatactcgttcggaccttctccataagctccaatagtagtaacaaatttgccgtcacgagtaaacagtttatatggagtctgctttttattactcaccaagatataattatcactcactgtggtacggacccatccccctatcaacgcctcatcccgattgtccagtttcacaatttgaagctcttcggtcaaataactgagtggaatatccacggtgtctttcaatgctttcaagtcacaggaaatcagtgttccggtaggtgttgagattcgcttacctacaactggcgacaaagccaaaggatcttttgttacctcactgttgaagataaaagcaaccagcgcgaacagccccaaagtacacaaactcaaaatcataattttctttttcatacgaacatgtatttagttagtttcaaatgaatattgggacaaaagtagatggaaagcaataaggcaacaaaaaaagcagcggacaaaaaagatgacgccagacgaatacatatcattgattatcaatgaaataagcatctatcgcattctttaagaggcggacaaatacattgaatccccaaaaatcaacagctaaaacgccttaagaaaactgtctaaacttacattttcatccgtaatacccagcctgtctgttttaatacggtatttccgtttggtaatagctgctttactgacacaataaatatctgaaaggtcttgtatgttaacattaatcttgacgagacaacagaaaccaatatccttattgttcaataacggataaatttgttccagtcttgtcgcaaaatggtcgaaagcttcgttgacaacagaaatcacctctacccactccgcatccgtcactacaattttacgactggaagccacttcatcctgactttcatcattatggagcgaaggtaacttccgaaaaaaggctatccgcctgaaaagggcctcacgcaattctgcttctttattttgcaaacggatttcttgctcccgtagtccgctgagctccgcctctttgtgtagcaaaagattttcccgttgcagccgtttcttcttctccttctgataaaagaaaaacactataaaaccgacactaagcaaagctgttacaatgcccagcatccatagttcttttccgcgttgtttcaaatgcaactgaaaaagttcgttttttaatttaagctcattatattctcttctttgtatttccgtcttggtactagtcagtatatcgtccttaatcttattctccttttgtttgatatagaaagcctgttccggatattctttttcattgattaagtcaaataagagggcattggcttccacggcaataaaatccgaagaagaggtcgcggcctgttgatagtaatacttggcagagtccgtctgattcaatgcctcataagatttgccacgaagaagaaaatagtgaggtatgacatgacggctatgccgttgagccgataattgacggagatacaatagtgatgtttggaagtcttttgcctccaaactggtagtcaataagttctccagtacatgataatttaaatattggtaattgggagaatctgcaaactctcccattaattgtagagactcttgtgtatatctgtcatagccctgtacttttttcagaagattcaagtaaagtctacttgctgaaaaataggcaagagtatctttgtttttacgagttaaccaccgactactgtctgccatattcaatgcctgcccataattctgatttcttgaatagactactcttttaaggccatacaattgtgttcttaatgtatcattcagcagttgttgtcgtagaagattatccgaaatcagcaatgtagaatcaggctggttactatataaataggaagcactttgggctatacgcgcttgaagacattgagataactgcccattttgcatatagcgatggatggcagtctgcaataacgattctactggtttcccggttttccacaaagttgctttataggataaaaagtaataatctccctgctctttagaagataaattctccggtttatctatttgctgaagataaaagaaaatactatcgacagaaacattttccatctgcatagcctttttcaaaactgaagacggggaagagtggcaggcggtcaatgtgataacccatccaacaagtagaagtatagtacgataattcatagttgcttaattttgactcaccaggattatgtaagtttacgccccttttatatatactaccgaacgtccgtatccatactttttcaatatcccttgctcgataaaagagttgatatcctgcaatgcctgcgtttttgtctttccgacaagctgtgcataatcccgccgattgatacacggatgttcttctaaaaactttgtcaaacgttgcaggcacttcttttcagacaacggattctttacacgaaacggcgaatgataaagttgtaacttgagttcactctcaatatcctttttaaactgccggttgacacggaaattaacatctttcagagatacggacggtgaacgcaattcttttgattccattactttcttgtcaacactcaatgaaagagtgaaataaccaatatctcccagctctacagaaaacccttttaagagtaaatgccgcagttcttttgatatagcttctataatgcccaccacttgcgcatgaggcatatgctgaaacgcagtcacctgttccacaaactcttcagccgtataactgcccttcaagacgacccgtgcatgtaaaggctgttcttccccgcttttagcaagatcgggagtttcataaagatcataatttacactcattatttattagcttttcattaggaaggattgataacctctctcccataaattaattttctaaaacacattccagtttccgattgacttaagtcaatcgatagtttaacttaagtcattctttcgttcaacttaagtaaaacgaaaaacagagtactaatgaaacaaatgtacgtagaataaacgtatactaatctatataaagtgagattttattttctgaatctcatttgtccttagttatttgccaatgctcttttcatctttaactctcatccaacaacggacctttgactgttctccaaccttatatttactaaacaaaggattttcactgcttttcatttattgtttaaatactttatagcagcttccaaaacttcatcacgtcctttacatatgccttgaattgtgtttttaacttcaatatcaggaagaatgccgatttgctgggtttccgacttatcaggatagtaaactccaagtcctgtaaatgttgctctgaagttaccaggcaaaatgattgatgaacaattgccatcagccccggcagttgtacttcccataacaacagtattgggagtacatctatatttcatagtcataaattctgcatggctttgtgttacctcatttactaggataacttttttaccttgataataatcttcattctcttttccagcttttattataggaccgaaggtaaacaatcctggctgcaaaagacttccgtgagtaaatatcgagaagtttgtagaagatggatacagagtattatactcccaatatccttcaattttcttcattacaggatatgctctcaaatcaataatcatcttttttgcttttatctcttggggaacttttccaccaatgttactccccaaatataaatacaaaatatcagaagggagaactgtaacaagtggatgaggcttttcgaagatagtagattcacgcattctattcggtaaacatttgattcttgatttttctacaacaccattcctttcatagtctacatacaatagtgtatcattggaccataaaagttcatcaacagctatccttctcaacaaagaagcttcgttagaagctgatatgtatggcgtgatacgttttatgatggaatctaccgcttcactgttgatacgtagaatcacatctcccggctgcaaaatttgcttctcctccttgaactcggattttaattcataatattctgttactacagctttgccttcaatgaaacgtatcacaacgggtactaaatatttttttgttggtccgccataaataccggcatgagtatcatggatttctgcaataaatctttttaaagcactctcgtaatccattctgctggtaatttccagaaataaaggtatatgattcaataatatctcattccaattgtccttaagaagatatttgtaaggaaaataatattgaattgcattccataaccggaataaagataagagctgatagtcaatattcggaaaagtacatttagaatatctttcttcgtgctcaaatactgcatttcccatatttatcacccctaaattcacataataacttgccgtatccctttctgcatccctaatttcttttaacctatctgacagtatcgttcccaagttacttttatcttctatccaatccaaatcaggaagtaattttatcgaatccgacgcacacagactatagatcccattcttctttttaaaatcaaattgatctatccattttactaaaacctcattccgcttttcttttgagggaagagatactaaagaaggcattatacaaagcagttcacgatcccaatcatattctccggcacgtaccgatgggtgatagtatttcataaatccccaaaccttacacaacaaagccagattctctacatctgcatgggtatattcccctccaggcatttcgggcgacatattattatccttatgtaaagaaatacaagaacaacaacaccatacaaatgacacgatcaacaagaatctggacatagtactaaattttaattagttaagcattaacgatagctgcaaatgtaaccgaagttttattagaacacaaacaatattgtacagaaaaacaacaatgttattaagctatactcatttaaggatagccacagactaatccgtatgcattttcaccaataattatccaagatttgaacgatttttttgttcactttcaaaagttttattccacacctaaaaagacagcctatcatttgcttttgctactaattcttcctaatattgtcctatactaatgaaaactaatacacataaaatgaatcccccatgaaaaaaatcgttcttttgataaccatacaaatcctgtgcatgcattcattcgtcgtgaatgcgcagcgtatattttccacctcctatacaatggatgatggactggcagccaacagagtatacagcattttgcaagattcatgcggattcatgtggttcggtaccgatgatggattaagcagattcgacggtattgcattcaagaactactatctatcagaatatatcaacgcaacaaccagcaacagcgtcaagaaaatatttatcgaccgcaggggcagaatgtggataggattggataccggaattgtcatttacgactcgaaaacagacactttccaacctttccatgccaaaactgaaactgaagaaatgatacaaacctacgtcaccgatatgatagaagacagtgacggagaagtatggattgcaacgagtggagaagggctttaccgtttttctccatctgataaagtcaggcttagagtataccggaatattcccggaaagattaatagcatctcccaaaacattatcatgacattgcagcaagacagtaaacaaaacatttggataggaacctattcggaaggattatgctgctttgataaacagaaaaacacgttcgtcacttacaaaaagagcaatcaccctaatagtttatcagataattccattcagaaagtgtttgaagactcacacggcaatttatggataggaacttttcagaacgggctcgacctgttcaatccagtgactaaaactttcaccaactaccgggacagaagtccaaacaacctattatatcatatccacgacattaaagaatacagacctggcgagttgttcatttcatccgacaacggtatgggaatttttaaagcagacaaaggagaaattatgcaatccgacaatccgaatctgaaaataagaaccggagccaataagtttatatataccatctatatggataaggaagaaagcctctggctgggctcctatttcgatggaatcaaattctattcggcatttcagaataatttcaaatattatagctgttcatcatcgtccacgccacaatcaggaaaagtaatcaatgttatcaaagaagacaaagatgataaatactggataggtacggatgacaatggcattttccgatttgatgccaaaactcaagaaattacccctttccgggatgcagctagtataggcacaacttactattgtatacacgatctgctggtagacggagataaactatatgccgccacttatggaagaggtttggaggtgattaatttaaaaacaggaaaagtggaaagttttctcgataatccggaagattcaacatctatcccctcctcacgggtattcactctatataaagccagtaatggatgtatttacgtgggcacttctgcaggattctgttactataaccccgaaaaaaacaatttcatcagaattggttcttttacaggcaaaatatcggatatcattgaagattatttcggaagaatatggataggaacaagcatcagtggattatattcatacaatgtcagaacccaaaagataacatcttatcaacgttcagaccatccgaattcactaacaaagaatgtaatcaccacgctagctatcgacaacaagaaacgactatgggtgggaacttatgggcaaggactttgtagatataatgatgaaacagatgattttaccagatacgactacctaaagttgccgaataaaatcatcacttccattatccctaaaggagacttattatggattagtaccaataagggacttgctgtatacaatccggatacagaatatctaaaaacctattcgaaatcaaacggactatacaatgaacaattcacaccatgttcaggctttgaatcttctgacggtagactatttttgggttcgacagacggtttctgttatttcttcccgcaagacttaagagaaaatacatacaatccacctgtcgtcctcactaatatgaccattttcggaaaagacatacaggccgatacatcccattcacccattcgccaatccataggatatacagatgagattgtgttgaaatataaccagtccatgatcggattcgattttgccgcactaagctacattgctcccaaagagaatgattatcaatatatgctggaaggtctggatagcgaatggcagttcactaaaggaagtaacaaccatctttcctatgcaaacttacccgtcggtgaatatgtattaaggatcaagggaacgaacagcgataaactatggagcagtaatgaagtacagctaaaaatcaaggtgctgcctccattcttccggtcgcaactggcttatctgatctatgccctcgtcctgttaattgcgattatgttaaccgtatggtattacgtaaaacgtacggagaaacatcagaaagaacgcatcaagaggctgaacgatgaaaaagaaaaagagctctataactccaaaatagatttcttcactaacattgcccatgagattcgaactcctttgagccttattatcggcccattggaatacctgatgaaaacttcaagtatcaacaatgtgtatggggaatacctaagtattattgaacagaattacaaacgcttgtatgcgcttgtcacccaattgctggatttccgcaaagtagatacgggatcttataaactatcgtacgactgttaccggattaaagaaataatatgcaaagtaagctgcatttttgaattatctgccagacaaaagaaagtggcgattgacacttcctctatcccggaagaactgagcatcgtcatagatgaagaagcttttaccaagattatcagcaatctactaagcaataccttgaaatatgccaaaagcacgattcgtattacgactatagaaaaggattccgagatagtagtcaccgtgaccgatgacggtataggcatcaccgatcaagaaaagactaaaatattcgacgcattctatcaggttaagaacaacagtgaaataaataaactgggcattggtatcgggcttcacatgacacgctcactcgtccaattgatgaacggaaagatcgaagtcagcgatagggaagacggtgaaaacggtgtttctatttctgtatatttccccaaacaagcggccatcactgctttgccacaagtggccaaacgagtggcagatacgattattccagaaaacagcatagaagaaaatgaactggaaagcactcttcccagtgaaccgttgaaaaaacaatatgccattatggttgtggacgacaacccggagattctggatttcctttccaaaattctgtccgaggaatattttgtcatatcggcttcgagtggagaggaagcgttgcaaatccttgaaaagaataacattgacctcatcatcagtgatgtgatgatggaggaaatggacgggttcgaactctgtgggaaaattaaaagtaacatcaatatttcccatgttcctgtcattctgctgacagccaaaacggatacagaaagtaaaatcaaaggactggaagccggtgcggatgcatatatagagaaaccattctcacctttccacctgaaagcacaattgctgaacttactcaagaaaagggaaagtcagcagaaaacgtatgcctctactccgttgtccgatctgcactccgctgtccacaataaactggatgaagaatttatgaataaatgtaccgaaatcatccagaataatattgaggactccgaattttcggtaaatacactggcacaggaactgggaatgagccgtacctctgtatttaccaaaatcaaaggcattattggcatgactcccaatgatttcatcaaggtcactcgattaaagaaagcctgcaaaatgatggtggagggagaatatagggttaccgaaataggattcctcgtcgggttcagttcttcttcctactttgccaaatgttttcagaaacaatttggaatgttaccgacagagtttctcaaaaaaataaaggaagacccctcatccgcaacaaaataagccggcaagcatcctccctttaagctaaatcttaagatttacagatgtaaaagttaacatcaacattggtaaatcttaagattttattaaattctccttataatataaggtaaggagaatctttttttttacttttgtccccgaatattgtggtacaagccattataaaagaaagaattatgcagaaaaaccttgtcattgtcgagtctccggcaaaagcaaaaacgattgaaaagtttcttgggaaagatttcaaagtcctttctagttacggacacatacgcgatctgaagaaaaaagaattcagcatcgacgtagagaagaattttacacccagctacgaaatcccggcagacaaaaaggctctggttaacacactgaagacagaagctaaagacgcagaaaccgtatggctcgcatccgatgaggaccgcgaaggagaagcgatagcctggcatctgtatgaggtcttaaaactaaaaccggaaaacacaaaacgaatcgtatttcatgaaattacgaaaagcgctattttaaaagcaattgaacaaccacgcgacattgacctcaacctcgtaaatgcacagcaagcacgacggattctggatcgtatcgtaggtttcgaactctctcccgtgctttggagaaaagtgaaaccggcactttctgccggacgtgttcagtcagttgctgtccgcctgatcgttgaacgtgaacgtgaaatacatgctttccaaacggaagctgcttatcgcatcactgccgtattcctcgtcccggacacggatggaaaactggtagaaatgaaagctgaactggctcgccgcattaaaacaaaagaagaagcaaaagccttcctcaacgcatgtcagggagcaagctttgctatcgacgatattactacccgcccggtcaagaaaacgcctcctgctccgttcacaacatctacattgcaacaggaagccgcacgcaaactgggatataccgtagcgcagaccatgatgctcgcgcaacgcttatacgaatcgggattcatcacttatatgcgtacggactctgtcaacctctcggaatttgcgacaacaggcagtaaagacgctatcatcaaaatgatgggtgaccgctacgtacacctccgtcatttcgaaacaaagactaagggtgcacaagaagcgcatgaggctatccgtcctacctatatggaaaaccagtccgttgaaggaacagcacaggaaaagaaactgtacgacttgatatggaaacgcaccattgcctcacaaatggcagatgcggaactggaaaagacaactgctaccataacaataagtggcagcagcgatgtatttacagctatcggtgaagtgattaagttcgacggattcttgcgcgtataccgtgaatcttatgatgatgacaacgaacaagaagatgagagtcacctgcttcctcctctgaaaaaaggccaaaagttggaacatgggcctattatcgcaaccgaacgtttcacccaacgtcctccacgctatacggaagcaagtcttgtacgcaagttggaagaactgggtatcggacgtccgtctacatatgcacctactatctctaccatccaacaacgcgaatacgtggagaaaggtaataaagacggggaagaacgacagtttaatgtcatgacattgaaagatcgtcagattaaggatgaaaaccatactgaaattaccggtgcagaaaaggctaaattactaccaacggatattggcactgtggtaaatgatttccttaccgaatatttcccggacattctggatttcaactttaccgccagcgtagaaaaggaatttgacgaaattgcagaaggagaagtaaagtggacttctatcatgaagaatttctatgataagttccacccgtctgtagaaagcacgttggctatcaagacggaacataaagtaggcgaacgtatcctgggagaagacccggagacaggaaaacccatttccgttaagattggccgcttcggtcctgttgtacagattggcactgtagaagatgaagaaaaaccacgctttgcacaaatgaagaagggccagtccatggaaaccattacattggaagaagcactggaattattcaaattgcctcgtacattgggcgaatatgaaggaaagacagtcagtgtcggtgtaggccgtttcggtccgtatatcctgcataataaggtatatgtatcgctccctaaaggactcgacccgatggaagttactttagaagaggcggaacaactcattttagacaaacgccagaaagaagtggaacgccacatcaagaagtttgaagaggaaccggaactcgagattttgaacggacgctatggaccttatattacctataaaggttccaattataaaatccccaaagatattgtcccacaggatttaacgctgaaaagttgtctcgacttaatcaagcttcaagacgaaaaaggagcgaatccagcaccaaaaaagaagttttcgaaaaagaagtaagaaaataaaataagaatgatggcagatatataaatctttttatatatctgccatttattttacttattttcaaaaacttatgagacaaacaatatttgtaaaaacattaatgggtctattttgtgccccattaatatgtggttgtgtagacgaccagcgtgatttatttcaagagccggaaaaacttcccaaagaaagcttttttgatttcaacatgaaccagaatctggctatagacattgactatggcttcaaagaagattatgtgattctttttgaaatttatgatcaagacccgattgaagtaaacgataaagatggtagctggaagaaaaaagacatagaacctttctaccgtgccgccaccagcaaaaagggaacgttcaatgaagatggaataactatacgggcagatatttcagaagtatggttatcatccgactatttaggtgcagcatcgcctgtaaaactcacaattggcgaagaccaccgtatttctttcaaccaaaatgagtatattcaatctctactcgcaaaagcatcaacacccgtcagcagaggagtgacaaccaatcagcataaatatcaggatgactggatgcttctacccaatgtagactggaacgacaacggacgtcccaataacttatctgcagaaaaaaacattccgcctgccagcgtactttataatataaaaaacgtttttagaaaaacggacgggaaaagcattcgtgacaactatcccgaattctttaacggaaaaatgatatcagacatccctatcactaaagaaaccgaagtaagtcttgtatttgtcaatagtactgccgcttggtacaacactgtgggatattacacttatcctactggcgaaacaccaactctggaaaatatccaaaaggtactggcatttccaaatgcttctcctgtttataaaacagccggagtaggtgctttagtttgtggcgatgaaattaaattgaaatactggaacgaaaaagaaggtaaatttgaagaaaaatttcctgctgggatcactattggttggtgtctgcaaggcatgggattcagaagcaagcctttagatgaatacgttcaaggtgaccttgttcaaggcatgggaacccgatactctactaccattttgaacaaagcgggaagtgatggcataaagagacaaagaaccgtatcactgcgagatacagaatccaatcaaattgtagcaataggatttgaggataatatagacttagattattgcgatgccattttctatatccatacttccgaaaaaaatgcgattgatgaagaagtagttcctcctttgcccgaagatcctgaagttccaactgatgaagacaactacaccacttactccggaatattgacattcgaggacttatggccggaacagggagattatgacatgaatgatgtcatgatacgatataagagtaaagtatataaatccatactgacaaatcgagtatacaaaattgttgatgaattcactccgtttcaccgaggaggttatttgataaacggctttggctatcaattacataacatcgctaacagcgatattagtgacgtttctattgaaggcccttcttatgcctccaaatctcaatatatgcctgggaaaacagagaccggccaatctcatcctacaattttattatttgataacatgaggatttttgacggaaaagaagaagcagacaaaaagtatactgtaacaattcaagtgaatgatgtaagctcaaaaaacgtattaccaccttataatccgtttattttcgtagagtcagataaaaccagaggtagagaagtgcatttggtaaaatatccccctacagataaagccaatccatcactattaggcactggcaaagatgtttccagacctgacgagggattatattatgtttcgatagacttaatgccatttgctctcaatatgccaattagcgaattccctatccctgaagaaggcgtaaggatagacgaatcatatccgaaatttgcaacatgggttaaatctaatggggcacaagccaaagactggtacaaataccctaaaaaataacagtcatcaacaataatgaaaagtcagactaggattaaacttagtctggctttttcatttgatcttaaaacctttatcaggaaataatatatcaaacacaatcacaaatataaaaacggatgtcaccaggatattcattgtcaataaagaaatgtgataaggccaggaaagcagtaaagctaaagcaaccacagcaataatatgcgataaaaagaagaatacgaatcggcctggtatccgaattaaaccggttagtcacccagatggtatgttgccacaacatccagactgcaaaccacaggattgtttctttcaataatccttcccaagtgagattatgaagcaaataatgtgaaagttgcgtgaccgagaaaacataaatcaggtcaaacagcagttcggaataagagacagtagcagtttccgtttctctcttccgaagcaatggatgggggggagtaaaacatacggggttccttttatatatataaaagaaaccccgcagaagtctattttgttcagagaaagtcttacattctggaaggaacttcgatacccagcaaattcattcccaagcgaacaactttagctacattaacagacagagcgatacggaatactttcaccgcctcattctcttcgcgcagaatactatagtcatgatagaactgattgtattctttcaccaagtcataagtataattagcaataatagacgggctgtaatcttcaccggcttgttttacaacagcagcaaagtcggcaaccatctgaatcagcccttcttccttttcactcaattcaataccagccggaatctgttcaggaatcacgatacctgattcggcagctttccgaagtacagactggatacgtgcataagtatattgaataaacggacctgtattaccattgaagtcgatagattctttcggattgaatgtcatattcttacgggcatcgactttcagaatgaaatatttcaatgctcccagacccacaatacgggcaatatcatcagcttcttcctgtgtcaaaccatccagtttgcctagttcttgtgaagtttctttagcagtggcaatcatttcctccatcaagtcgtcagcatcaactaccgtaccctcacgggatttcatcttaccttccggcagttccaccattccgtaagagaagtgtaccagactcttaccccattcgaaaccaagtttatcgagcaagatagaaagcacctggaagtgatagttctgttcgttacctactacataaatcatcttattaatcgggtaatcggcaaaacgaagtttagccgtaccgatatcctgagtcatgtagacagaagtaccgtcaccacggagaaggagcttatgatccagtccttcggcagtcaggtcggcccatacggaaccgtcttctttcttgtagaagaaacctttttccagaccttccattactttttcttttccttcgaggtaagtattggattcgtaatagatcttgtcgaagctgacacccatcttcttgtaggtttcgtcgaatcctgcatatacccagttgttcatcatttcccacaatccgcgtacttccggatcaccggcttcccacttcaccaacatttcgcgggcctcctgcatcaatggagattcagcttcagcctttgctttcgcttcatcgtcactcattccctgcgctgtaaatttagccatcagctcctttacttccgctttataatgcttatcgaaagatacataataatcacctaccaggtggtcacccttcttacccgaagtttcaggagtttcaccgtttccgtatttcttccatgccagcatggacttacagatgtggataccacggtcgtttacaatatttgttttgactaccttattgccgtttgccgctacaatgttagccaatgcgttacctaaaaggttattacgcacgtgtcccaagtgaagcggtttatttgtattcggagaagaatattcaatcatcaccaatggagaagcgtcagtgacctgcactaagccgtactgttcatctgcctgaatctcgttcagcaactcaatccatgtagccgatgcaatagtcaggttcaagaacccttttatcacattaaacgctgctacagccggatcgtttgccttcagatattcaccgatttcctgtgccgtttgctccggtcctttttttgacatcttcaggaaagggaacacgaccagtgtcaaatgtccttcaaattctttcttcgttttttgcatctgcaccattttttcagggacttcctgaccgtagagtgctttcagtccgctgataacggacgctacaagtttatcttctatcttcataatcaagttatttcttgcgcgcaaagatacaaaaaaaggagacgcatcgcgtctcctctcctaatttctttcaactatctatcttattcaacagctgcagataattcagcaccagctttaaatttagctactttcttagcaggaatagtaatagttgcctttgtagaagggttaataccagttctttcagctctttcgcttactgagaaagtaccaaaacctacgagagatactttgtcaccagctttcatagcattagtaactgaagtgatgaaagcatcaagtgctttttttgcatcggctttgctcatttgagcttcagcagccattgcgctaataagatcagacttattcataatacgtaaaatgattaattaatatatttgttacacaaaagattatcccacaatggattgattccacaaatatagccgaacaaaacaacatatcaaataaaaacataaaaaaaacgcagcaaattattgaaaaagagctaataggaagcgtttttcatgctttaaaacagaatttattcgtacttttgcgtctattatctaaatattcagaaattaaaatgatgccaactgtaactaaaaacctgataattatcaatgtactagtatttttcgggacaatcgtagcccaacgttacggcctggatttaacgaattatctaggattacattttttcctcgcaagtgactttaatccggcacagcttatcacttatatgttcatgcacggcggattcagccacattttctttaatatgtttgccgtttttatgttcggaccgattctcgaacaaacctggggacccaaacgtttcctcttttactatattctctgcggtatcggtgcgggacttatccaggaaggggtacagtatattcaatatgtaacggaacttagccactacgcacaagtgaatataggtacaggtgttatcccaatggaagagtatctgaacatgatgaccaccgtaggtgcttcgggagccgtttacgccatattgctggcattcggtatgttatttcccaataaccggttgtttatcttcccgctgccatttcctatcaaagcgaagttcttcgtgataggatacgccgcgattgaattatggtcaggacttgccaatagcgccggagacaatgtcgctcactttgctcacctgggaggaatgttatttggattgatcctgattttgtattggagaaaaaaaagcaataacaatgggacatattatagctgatttaaaggagacattcagaagaggaaatattttcatccaactgatttatatcaacgtaggcatctttctgatcggcacgttgattaacgttttcttgcgactgtttgaagtaagtacccccgatatattcggtatatttgccctgccggcatcctttatcggatttattcatcagccgtggtcgttatttacttatatgtttatgcatgccggtatcctgcatattctattcaatatgctttggctgtattggttcggaagtttgtttctctactttttctcggccaagcatttaagaggactatatgtattaggaggtatctgtggaggtttactgtatatggttgcctacaatgtatttcctttattcagttcgcaagtggcgggtgcaacattggtaggagcatcagcttccgtattagccatcgtagctgctacggcttatcgtgaaccaaattacagggtgcaactttttcttttcggtgctatccgtctcaaatatctggcactggttgttatcggaatcgatgtattatccatcacctcaagtaatgccggaggacatatcgcccacctgggcggtgctcttgcaggactttggtttgccgccagcctaagtaaaggaactgatttgacttcctggatcaactggattctggatggtttcgcctccttgtttcaaaagaaaacatggaaacggaaaccgaaaatgaaggtacactatggaaacagtgccaccggtcgcgagaaggattatgattacaatgcccacaaaaaagcacagtctgatgaagtggaccgtattttggaaaaactaaagaaatccggttacgacagtctgacaactgaagaaaagaaaagcttgttcgacgcaagcaaaagataaaggaatggaacatattggcaaatttgtcgcatatctgatacttgctgtcaacgctctcttcgtgggaacgttgatattaagcgcttatagcccttaccttaacccgaaaataaatccacttgcttccagcttgggacttgcatttccgatattcctgacgattaatctgatttttatcggcttctgggcatttgtcaattaccgctatgcgctcttgcctgccatcggttttctaatttgtattccgcagatacggacttatattccttttaactccaccactaaaaccataccggaaggaagcatcaaaatcctatcctacaacgtaatgagtttcaacaatttggagaagaaagatgggaaaaacccggtattgtcttatcttgtagatagtaacgccgatattatctgtctgcaagaatataacaccgctaccaacaagaaatacctgacggaacaggacattaaaaaagcattcaaagcctatccttaccaatccgtccaccaacaagggaaaggagatgtgcaacttgcctgtttctctaagttccccatactctcgatacatcccatcgaatatgaaagtaattataacggctccatgaaatatgtactgaatgtgaataacgacactcttacattaatcaacaaccacctggaatccaacaaactcaccaaagaagacagagggatgtatgaggatatgattaaagacccgaatgccaagaaagtaaaaaccggacttaggcaattaataagaaaactggcggaagcatcggctatccgggctacacaagcagattctgtggctaaaaccattgcagaaagtaaatatccgacaaccatagtatgcggcgatttcaacgacggttctatctcatatacccatcgcatcctgactcaaaaactagacgatgcattcacacagtccggtaaaggattgggtatttcctacaatcagaacaagttctatttccgcatagacaatatcttgatcagccccaacctgaaagcctacaattgcacggtagaccggtctatcaaggcatcagaccattacccgatctggtgctatatcagtaaacgataagaactgaaaactctaataaaaaacacttatgatgattaaaaagacactaaccattttagcagtaagttgtatgatgtactcctgtgctacgaaaacagaaagcaatcctttctttacagagtttcaaaccgagtatggtgttccttctttcgacaagattaaattagagcactatgaacctgcctttctaaaaggtatagaagaacagaatcaaaatatcgaagccatcatcgaaagcccggaaattccgacattcgaaaatacgattgtggctttggataacagcgcacccatcttagaccgggtaagcatcattttcttcaatatgacagatgcggaaactactgattcgctgaccgcactttccatcaaactggcaccggttctttcggaacataatgacaatatctccctgaatgggaaactattcaaacgggtgaacgatgtctaccaaaagaaagattcattgaacctgacgtcggaacaagaacgtctgctggacaagacttataaaagatttgtccgttccggagcaaaccttaatgccgaagaccaaacccgcctccgcgaaatcaacaaggaactttctacactcggcattactttcagcaacaatatactgaatgagaataatgctttcaaactcttcgttgacaaagaagaagatctggcaggattgcccgaatggttccgccaaagcgccgcggaagaagcaaaagcagccggacaacccggaaaatggctattcaccctgcataatgccagccgcctgcctttcctgcaatattcagaaaatcgcccgcttcgggaacaaatatacaaagcttacatcaaccgcggtaacaacaacgacgaaaacgataacaaggaaaatatccgtaagatcgtttctctccgcctggaaaaagctaaattattaggtttcgactgctatgcaaacttcgttctcgacgaaacgatggcaaagaacgccaacaacgtaatgagccttctaaacaacctttggagctatgcactgccaaaagcaaaggcagaagctaccgaacttcaaaaattaatggataaggaaggcaaaggagaaaaactggaagcatgggattggtggtattataccgaaaaactacgaaaagaaaagtacaacctgtctgaagaggatacaaaaccttacttcaaattggagaatgtgcgcgatggtgctttcgccgtagccaacaaactatatggcatcacccttaccaagctcgaaggtatccctacctatcatccggatgtggaagtctttgaagtgaaagacgcagacggttcgcaactcggtatcttctacgtcgattatttcccacgctccggaaaaagtggcggcgcatggatgagcaactaccgcgaacaacaaggagatacccgtccgttagtatgcaatgtttgcagctttaccaaaccggtaggcgatactccctctctattgacaatggatgaagtagaaactttgttccacgaatttggccacgctctgcatggactgctgacaaaatgtgaatacaaaggaacatcaggcactaatgtagtacgcgattttgtagaacttccttctcaaatcaatgaacactgggctactgaaccggaagtactgaaaatgtatgccaaacattatcagacaggagaagtgatacccgacgaaatcatcgaaaagatactgcaacagaagactttcaatcagggcttcatgactaccgaattactggctgccgccatcctcgacatgaacctgcacaccgtaacagatgtaaagaatatagacatgcttgcattcgaaaaagaagccatggacaagctcggtctcatccccgaaatagcaccgcgttatcgcgtgacttacttcaatcatatcattggtggttacgcagccggatactacagctacctatgggccaatgtactggataatgatgcttttgaagcctttaaagaacatggtatttttgataaaaacaccgccgacctcttccgtcacaacgtattggagaagggagacagcgaagacccgatggtgctttaccggaatttccgtggagcggaaccaagcttggaaccgctactgaaaaacagaggaatgaaataattcagtaaaaaagcccttaaacatcaaatatttgagggcttattacacatgaatgtgaaaaaaaaactatatttgcagccttgtatacggcaaaaagaacttgtgtacgacagaatttaactgaaaattaaattaaaaaagtaatcatcataaattaaaagtaaaatgcaaaacaaaggatttgtaaaggtttttgcggtattactcacgctggtatgcgtgttctacctctccttctccttcgtaacacgccattataccaacaaggcgaaagaaattgcgaacggcgacccgaaagtggaacaagactacctcgactctctctctaacgagaaagtaatgctgtggaactggacactgaaacaatgtcgtgagatggagattagtttaggtttggacctgaagggtggtatgaacgttatccttgaagtttccgtacctgatgttatcaaagcattggcagacaacaagcctgacgaagctttcaacaacgcattggcgacagctgcaaaacaggctgtcaacagtcaggatgatgttatcaccctgttcatcagagaataccacaaaattgctccggacgcaaaactttccgaacttttcgcaacacaacagttgaaagataaagttaaccagaaatcatcagatgcagaagttgaaaaagtgctgagagcagaagtaaaagctgctgttgaaaactcattcaacgttcttcgtacccgtatcgaccgttttggtgttgttcaaccgaacatccaaagtctggaagacaaaatgggacgtatcatggtggaacttccgggtatcaaagagccggaacgtgtgagaaaacttctccaaggttctgccaatctggagttctgggaaacttatacagctagagaagttctccctgccatgcaatctgcagacgccaaattgcgtgttattttagctgaaggaacaacagctgatacagatactattgaagcagtccttaccgaagccactccggttgagaaaaaaactgtaagtgctgccgacagccttgcagctgccctgaaaggtgacgtaactgctgaagataagtctgccgcaaatatgaaagaaatcaaaaagcaatatcctttgctgtccatacttcagttgaattctagcggacaaggtcccgttattggttatgccaactacaaagatactgctgacatcaacaaatatctggctatgccggaaatcaaagctgatcttccaaaagaccttcgtctgaaatggggtgtttctccttccgaatttgacaagaaaggacagactttcgaattatacgctatcaagtctaccgaacgtaatggtaaagctccgttggaaggtgacgtagtaactgatgcaaaagacgaattcgaccaatacagcaaaccggctgtaagcatgacaatgaactctgacggtgcacgccgctgggctcagttgactaagcagaacattggccgttccattgctatcgttcttgataactatgtatattctgcaccaaacgtaaactctgaaattacaggtggacgttcacagattacaggtcatttcactcctgaacaagcaaaagacttagctaacgtattgaaatcaggtaagatgccggctccggctcacatcgtacaggaagatatcgttggtccgtcactgggtcaagaatcaatcaatgcgggtattttctcattcgttgtagccctgattctgttgatgatttacatgtgctctatgtacggcttcatcccaggtatggttgctaactgcgcgttaatcctcaacttcttcttcacgctaggtattctttcatccttccaggctgcgctgacaatgtccggtatagccggtatggtattgtcacttggtatggctgtggatgcgaacgtacttatctatgaacgtacaaaagaagagcttcgtgcaggtaagggtgtgaagaaagcacttgccgacggttattcaaatgcattctcggctatcttcgactctaacttaacatctatcatcacaggtatcatcctgtttaactttggtaccggtccaattcgtggttttgctacgacattgattatcggtatcttggtatccttctttactgcagtgttcattactcgtattgtttatgaacacttcatgaacaaagacaagtggttgaacctgacattcacaaccaagatttcaaagaatctgatgaccaatacacatttcgattttatgggtacaaacaaaaagtcccttattatcgtcagtgcaatcatcgttgtttgtatcggttcatttgccatccgtggtttgagtcagagtatcgacttcactggtggacgtaactttaaggtacaatttgagaatcctgtagaaccggaacaagttcgtgaattgatctctagcaaatttggcgacgccaacgtaagcgttattgctatcggtacagacaaaaagaccgtacgtatcagtacaaactaccgtatcgaagatgaaggcaacaacgtagactctgaaatcgaatcatatctatatgaaaccttgaagccggtattgactcagaatatcacattggaaactttcatcgaccgtgacaatcacacaggtggtagtatcgtaagctcacagaaagtgggtccgagtatcgcagacgacatcaagacaggtgctatctactctgtagtattggcactgctcgccatcggtttgtatatcttgctccgtttccgcaacattgcttacagtatcggttctatcgtagctttgagttgcgacaccattatgattatcggtgcctattcactgttctggggtatcctgccattctctctggaaatcgaccagacatttattggtgctatcctgacagctatcggttactctattaatgataaggtggtaatcttcgaccgtgtacgtgagttcttcggtttatatccgaaacgtgacaaacgagtattgttcaacgactctctgaacacaacgctggctcgtaccatcaatacatcattaagtacattgatcgtattgctgtgtatcttcatccttggtggtgattcaatccgcagctttgcattcgcaatgatcctgggtgttgttatcggtacattatcttcattgtttattgcatctccaattgcatacaacatgatgaagaacaaaaaagtcgtagtaccagctacggaagaataataaactccacaaatagaaaagcctcttccgaacattcggtagaggctttttctattgattattaaaacaaatagaagctataagacgttcatcttaaaagaagctattgttacacttaaaacttgatacaatatgaaagcaaaacaacaccactctcatagattcttctgtagtagccccgaggggaatcgaacccctatctaaagtttaggaaacttctattctatccgttgaactacaaggccgcttcaaatttgcttgcaaagataacggtttctgtcgatttaacaagaataaaaatgcaggttcctttcagatatttcaaataattggcgtcaataggacaataaagtaggatttattttgataattcgattaactttccgacctttgcgctcacaaattgaaagtaaaatcagtttttaaattaaatatagtaattaaagttatggcagacgaaatgatggttaaagaattggaggaagtagtagtacgtttctccggcgactccggcgatggtatgcagctagccggcaacatcttctcgaacgtgtcggctacagtgggaaatgacatctgtacattccctgactatccggcagacatccgcgccccgcaaggttcgctaaccggtgtttccggtttccaggtccacatcggcgccggacaagtttacactcccggagaccgttgtcacgtattggtggctatgaacccttccgcactgaaaacacaaatcaaattctgtaaaccgcaaggacttatcatcaccgactccgactcattcgaagccagagatttggaaaaggcacaatttaaaaccaacaatccctttgaagaattaggaataaaacaggaagtattggaagttcctatctcttccatgtgcaaagagagcctgaaagactccggattggataacaaatcgattctccgttgcaaaaacatgtttgcacttggattggtttgctggttgttcaaccgtaaccttgctgctgctgaaaaaatgctgcgcgagaaattcgccaagaaacccgaaatagcagaagctaatattaaggtattgaacgatggcttcaactacggagcaaacactcatgcttctgtctctacttataagattgaaagcaaagctccgaaatcaaaaggactttatacagatatcaacggtaataaagcaaccgcctacggactgattgccgcagctgaaaaagcaggtctggggctctacctgggttcttatcctatcactccggctactgatattctgcacgaattagccaagcataaatcattgggagtcaaaaccgtacagtgcgaagatgaaatcgcaggttgtgcttctgcagttggtgccgcttttgccggtgctttggcagtgactacgacttccggccccggtgtttgcctgaagagtgaggcgatgaaccttgctgtaatcggtgaacttccattggtgattgtcaatgtacagcgtggcggtccgtctaccggtcttcctactaaatcagaacagaccgacttattacaagccctttacggacgcaacggcgaaagcccgatgcctgtaatcgctgcaacatcgccgaccaactgtttcgacgccgcttatatggcatgcaagatggccttggaacacatgactccggttgtattgctgactgatgctttcgtagctaacggttctgccgcatggaaactccctaatctggatgaatatcctgccatcaatcctccgtatgtgaccccggatatggccggcaactggactccttaccaacgtaatccggaaacaggcgtacgctactgggctactccgggaactgaaggattcatgcaccgcatcggtggtcttgaaaagagcaacgaaacaggcgctatctctaccgaacccgaaaaccacaataagatggttcatctgcgtcaggccaaagtggataaaattgcagactatatccccgaactcgaagtattgggtgacgaagatgcagacttattgattgtgggttggggtggtacttacggtcatctccgtctggctatggactatatgcgcgaacatggaaagaaagtggctttcgttcacttccagtacatcaacccgctgccgaagaacacagccgatgtattgcataaatacaagaaaatcgtggtagctgaacagaatctgggacaattcgcaggttatttgcgcatgaaagtgcccggattgaacatcagccagttcaaccaagtgaaaggacagcctttcgttacgagagaattgatagatgcattcactaaattattggaggaataaaagatgagcgataaagtatataccgtacaagattataaatcaggccaaccacgctggtgtccgggatgcggtgaccacgctttcctgaactcactgcacaaagctatggccgaactgggagtagctccgcatgatattgccgtcatttccggtatcggttgttcttcccgtctgccttactatgtaaatacatatgggttccacactatccacggacgtgccgctgctgttgcaacaggagctaaagtagccaatcccaatttgactatctggcagatttccggtgatggtgacggccttgcaattggtggtaaccacttcatccacgcattacgccgtaatgtcgacctgaatatgattcttctgaacaaccgtatctacggtctgacaaaaggacaatattcaccgacttcagaacgcggacttgtcaccaaatcatctccttacggaacagtggaagacccgttccatccggcagagctggcttttggcgcccgcggacgtttctttgcacgctgcattgcagtagatggtgccgcttctgtagaagtgttgaaagcagcagccaatcacaaaggtgcttctgttgtagaagttctacagaactgcgtgatcttcaacgacggaactcacgccagcgttgccaccaaagaaggacgtgccaagaatgctatctatctggaacatggcaaaccgatgttatttggtgaaaacaaggagttcggattgatgcaggaaggcttcgggctgaaggtagtgaaactgggtgagaacggtatcacagaaaaggatatccttatccacgacgcacactgccaagataatacgcttcaactgaagctggctttgatggaaggtcccgacttcccgattgcactcggtgtaatccgtgatgtagacgctccgacttacaacgatgctgtcgttgaacaaatcgaagaaatcaaaggcaagaagaaatatcacaatttccaggagctgttgatgactaatgatacttgggaagtgaagtaattcactgctcatcaataatataaaagctggaggaaggataaaacaatcccttactccagctttcattataaatacacctcaagtttgcttaaaggtcatcttcagtcatcccacagcatactgggcgtcaccccacaagccgtgatttgtttcatgccatgaaaccatttgtttctcaccgagaaacaaagtgttttttcaagatgcgcaaatatagtgcaaacctattaaaattcagcaaaaatataagaatgaaaaaagggcgacaagatagaatcgcggagacgcttacagctactttttcctatatgggaagataatacaaattaagggtgaatggtagtaagttctatcctgactataaacaaagaaggcggctcctgtacccggaaccgccttcatctcctaaaaaaagatctctaaccaaacatctacctatttcaactcaaatggtacaatacctttaatatctctggatgaactaccgatgatcgcctcaaacttgcccggttcggccacccattcgtgtttggcatcatcaaagaagctcaatgctttcttatcaatcgtcagcgttactgctttctcttcgcccggagccagtttcactttttggaaacctttcaactcttttaccggacgagggagcgaggatttcttatcactgatataaagctgaacaacctcctgaccttcacgagtgcctgtattcttcacattgactgtgaaagaaatggtatcatctgctgtcattgttttcttgtcggccgagggttttccataggcgaaagtagtgtagctcaatccgtgtccgaacgggaacaacggtttgattttctctttatccgcccagcgataacctacgaaaatatcttcccgatagatttcattaatggtgtcccctctatgtttagactgtgccagttcttctttattacccggatattcgcccagtttatgagcacctacatcttccagttttgcagggaaagtgaaaggaagttttcctgaaggattggcgtctcccaccaatacggaagcaagagctgttccggcttccgaacccaggaaccaaccttgaacaatagcaggcacttcattcacccaaggcatagccactgcattgccggagatattgacaacaatcaggtttttattcacctttgccagttcgcttatcactctatcctgcgcgtatggcaaacccaaagaggcacggtccgaatcttcacagtcctgatgattactcttgttcaagccaccgaagaagataacatagtcggcatctttagccacttgcaaagcctcagcgagcagttcatcttccgaacggttgtccttcaaatcctgaccggttttcacaccgttatactctcctgtcggatcgcctacatacccacgggcatataccacttccgcttttgagcccacacggcttttcagtccatccaacggagaaatctcatatttcactttcaaagaagaactaccaccgcccacagtcatcatctttatcgcattttcaccgatcactgcgattttcttcgttttattcaaatcgataggcaatacgttaccgttgttctgcaacaatacaatgccttcttctccaatctgacgtccggcttgtccgtgctcgggagaacctaaagagccgaacggtttgtgcggatccattgaagtacggaatatcagacgaaggacattgctaaccttttcgtccagttcctttgttcctactttaccctcttttatcagtttcaggtaagggaaagcaaggtaataattatcatacgcatttctcgttccggcagacagtccgttcgtccaggaaccaaattccaagtccataccattgtgaatagcctgttcggtgttgtgcacacctccccagtcggacactacaacgccatcaaaaccccattcatcacgaagaatatctttaagcagacgtttgttgtgacaagcgtgctgtccctgataaagattataagagcccataatcgaccatgttccaccttcctgaacagccgctttaaaagcaggcaggtatatttcataaagagcacgatcactcaattgcacattagtggtatgacggttgaactcctgattgttcaatgcataatgcttcacacaggcagctaccccgttctcttgtacacctttgatgtaaggaaccaccatagtggcggatagatacgggtcttctcccatatactcgaagttacgtccgttcaagggagtacggtagatattcacaccgggacccaacaagatgtctttcttgcgataacgcgcctcttcaccgatacttttcccataaagatgcgacatttcggggttccatgtagcagaaagacacgtcagtgccggataggcaatacaggagtcgtttgtccatcctgcctgatcccattcatcccacaacacttccggacggataccgtgaggaccgtcggtagcccatacttcggggattccgaggcggggaacgcctgccgaactaaatttagactgtgcatgaatcatcttcaccttttcttcaagggtcatccggttcaatgcatctttcactcgctcttcgataggcttaccagtatccagatacacgggcttctgcgcaaaggcagacaacgcagtcatcacagacaagccaagtaacattgctttgagtttcatgtttattgatgatataagaaatgagttaatactttatttatatagactcccaaacaggggatatttcctagttgcggacgggtttattaatgttttttacattattccgaccaaagatgaatcctgaaagggtacaattcatcataccctttcaggataggttcaataaaaatccggcatcaatcttcagatcaatttattttctcaaccttcagatcagcatttgcattgccattcgttacatcaatggtaaatcgatagacagctccttcttcaaatgctttattatcctgcatttccaaatttccggaatctgcaagtttaagctgttccactaaaatagagcttgcataattgccgaattctcctccccaatcattttgatggaagaacttaaaactaatcacttccgggtcaccactagtcttcaacgtttccccggctttcaaggttagctgatactttttagaagcaacttgcgccagacagagcgctttacttggctcccaacctacttcggaagacgtaacagaaggcttaccgattccttttccgatagcccagattgcacccgttccgtcatcttgcaatttggccggtttaccatctttcaaagccattacagaaaaatacttcaaaacagcattagctgtcacccgataatctccgttaatcggcaggaacttcaatgcaccatcactttgtttctcaaagaaatcaggatcgatccaccattcattcaaattatcaatgcctgtaacagttatcatttgtccttgtgtaaacgcctgatccgacttatatatatcagtatctgtcacctccatcttatcattaccaaagaaaatatccggtgcaggtaaatctaccttccctactttctccactgtcaacacagccttggtattgcctttcgtcacatcaactgtaaacctgtaaatacctcctctttcgaacttctgaccttcttccagtcccaagtttccgtccgatgagattttaaccaattcactcgttgtagaaatagcatcacccttaaactcgccgttgtcccatttattgatatggaagaacttaaagttaatatcatccactttcatggtaacgccagctataaatgtcagttgatacttcttcgcagtaagctgtggcatacacagaccgttttccggagtccaccctacttcagaaagtgccaccgacggtttaccgattcctgttccaatagcccagatagcacctgttccatcatcctgcaacttggcagcctcaccattcttcaaagcaatgacagagaaatacttcattttaccattggctgttatttggtaacttccgtcaatcggcaggaatttcaatgttccatcttcctgcttttcaaaataatcctggtctatccaccaattatcataatcaggcaccccttcaaacgctagaatgtcattcttcttcaaagtcaacttgattgcatagatatcattctctaccaattccatatcttcaccgttcacctttaacttggcaaatggttctgcctcgtaagtcaacgtattaaacttgatagcataatttcccggttccgtattagaaaatgagatagcattagtagaaccggcttcaatcgttccattctcccagccgaaggtcaattcgttcccattctctcccactttcggagtcttgatatacgctttcatcttttgcgagaagtctcctgtcacactatacttgtacatggcttgccgttccatccggtactcttttccttcctcatccactaatgtcagataggggaagtccggtcgtgccagagcgagttctttcgtcatttctgtggtagtaaaatgaatgttctgaagaatatatttcaaagttgcctttccattaggaatattagcataataaggaacaaagattttaccagtatagtcatttccgcttgtctttgtacggatgaccgtttcagacacttgttcttctccataaaaaagctgtgctttcaacgtagaaagaggcacatccacatccgaggctttaatcgtaaacggaagactgtcaccaaaaagagcatctgcattctctgctttgatttccatactcggattaccgggcaagaattcgtcatcattacaggaattcatggataacattcctgccaaagccaatataatataactgttttttttcattgtcttgatcgttttaaagttcttattccgactttgcccaacgataggaagtcacagatttgcccggaacatcataagcaaaatgacgcttaccatcacttaaggttatctttttagtcttttcattattattcatcagtacaaaagcgtatgttccatccggattctcgaaagcagaatacatgatattgctatcagcatagccggatgcaccgatacgtaccgctcccggtttcaccacacttgagagatgggcgatgatataataatgtgagttgcggataattgtcttatagtcgctattactgatatccaccgctccgtagcaagtctggcaaccgccttcacggttaggagcacggtcattatcaagcatcaggttccacactataactcccctacaccagttgttgatcgtacccaatgctacttctttcatatcttccagcaatcgtttcgacaaatcacgtccgctattccatgttccgatagaagtctccgtgaaaagaagttccttttcaggataggctttatgtatatttaaaagctcttcgcgattcccgccatagttgtgataagcagctccggccaggtattgggaagcagctgcgtcctcatacatcttaccggggtagttcttttccgttgcaatatcactataatcatagttatgatcgtatgcataaattttcgtagccagtccggctgttttgaatttaggtccgagtgctgttttcacaaagtccctctgttcttcccaactcatataaagtgaagcggaattaccacggttcaacggttcgttctggggagttacagcataaatatcaatgccttcggcgttgaaggcttgtacccatttcacaaaataagtggcatagtcctgataataggctggattcagctgaccgtttgtccatgaatccagcggagtaagatctgtgagactctttactttcatccattttggacaagtccaaggggcggcaatgactttaatagaaggattgatgctcaaaatctctttcagaatcggaaggatatagtctttctcttcactttgcaaagcaaaatgctcaatacctttcgtatcacagcaggtatattcgctcaatgaaaagtccgagcagccgatagagatacggatatagctaaatccgaagcctttgtcgtcagagaatgtttccgtaaggaaggcgtgacgatcttccggtttcatttgcagaagattaaaacaagtggcgcctgtgatagcagctccgaagccatccattgtctgatattgttcagtcggattcaatgtgattgaagtaggtgccaaattatctttcgagctgaaattaacggcatcacgggtcaaatcgcgagtcaggctgctagtggtcgcataaatagtcacatctccggtcggaacaggtgtaaccggtttctccgcatcgtcactgttgctgcatgcagctaatatggtgaagcatcctaaaaaggtcaatgctatatttctcatgtctatcataatcttaagttttctatgtttttagttgaattaataacccggattctggtgaatcttatcattcgcgtcgattaccgactgcggaattggcaaacgataagagttcttatcaaaagtgtaaatctgcgctttgcgacctgaatccttggaatacactgcattcatcacctcttctaccttgtccagacggaccagatcaaaccatcgttgtccctcaaaagccagttctaaccgacgttctttaagtaaggcattcagcaggacgtttttgtttgaacggacagaggtgggaagtgctcccaatttggcacggtcgcgcacttcatctattatatcggcggctccttccaaatccggcgtatcctgcataatcagtgcttctgctttcagcaacaggacatcggcataacggtacttgataatactgctgttggcagagcggcatttatacatgaacggataattatcagacggataatagttgctccaattacaatcgtaatagactattgattctttgaaacggacttcatccccttcctgtttgaaagcactaatcaggtcacgggacggagtcacccatttcgcccacgtgaaattgttattccagttcacgagatcacgcccgaacatccatgtacaccagttacctgctccggatgtaaattgtgcttcaagaatcgattcttttgtattacgcatctttgcatctgttcccgcagcattcattccaaacaaatcactgaaatcatctaccagatcaaaaccgtctgctttcacctcatcacaatattggataactttcgtataatcacgcaaaggtttctcggcatatattttagccaataaggtacgagctacagatttggaaaacaacgtcttattccccggcgtattgtccggagcatacaatactgcatccaataaatccttttcaatctgctgataagcttcaagttccgtattttgtttggggaaatattgtggatatacctcatcaatgttttcagaagtaatatcatcagccaccgttgtaatcacagggaaatcaccccacagacgtaccatgtcgaacattaccatggcacggaatatcttcgcttctgctttgtattgcgcccgttcggcagtagtcaacgaattatctgtcaccaggtcaatgttacaaatgagtttattggcacgggccacatcctccaaataacggttccagtcacgttccaacacagaattggaaccttcaatcgagttattctcaaacgggacaacttccgctccggtagtaccggcataagcgttatccgcatgagagtctgaaatcaaaagtaaatccacataccaatgttcctgacggtcgcgcatttgattataaagcgttatcagatgactttcaactgcagctttatccttgaatacgatttttgtaccatcacttgtcactccttccgtcacatccgaataggtgtctaatggctcataattcagcgagcaggaagaaagtcccaatagcaagccggaggttaatccgtaaaatatagttcttagtttcataatctttcctttcattagaattcaacattaataccaaacacgtatgatctgcaatgagggtaagtaccccaatcgataccttgtaccgtaccgctgttaccccattggtttacttccgggtccattcccgaatagctggtccatgtcagcaggttagtagccgtgaagtaaggctgcaaacgggtaattccccatttcttcaatagtttacctttaacgttgtaggacaaggaaacatccttcaatcttagataactgccatcttctacaaaataggtagaattgagtaatttgaaattagccttaggcacgtctgttatctgtccgggtattttccaacgactcagtacacgggccgactgattcttaccatcatacataccttccgtttcaatacgtgaagcattataaatatcgtttccataagaaccttggataaagatactcaaattaaagcctttccatgaaaaggtattagtcataccataggtgaaatccggattcggatcaccgatataggtacggtcggaagatgatattttaccgtcattgttcaaatcacgatacatcaattcaccggtttcaggatctaccccatcacttatataaccgtagaaacctcccaaagcacggcccggctcattacgtaccacatagtcattcaccacatccgcagttttagcatcgtaataaactttctgtaattccagttttgtcaatttattccggttaaaagagatattgaagtctgtatcccatgtaaatgctcctccacgaagatttttcgaactaatagaaagctcaaaacccttatttaccatttcaccctcgttacgggcaatagacgtagcggctgcggcaccggcaggtaatgatacattcatcaacatgtttttggtcttcttataataatagtcggcattaaacgtcaaccgtccattcaatatggtcagatccagacctatattggtctgtgtcgtggtttcccatgttaaatcagatgtacgcaagttggcctggctaatggtaggaacagcatttgcataatcagtagaatcaccttcgccgcctttcttaaaccattcgatacgaccgatattgtaacgctgcaaatatgcatagtcaccaatacccgactggttaccggtttgtccccagccaccgcgcaattttaaatcgtcaatccatgtaaggttctccatgaacttttccgaagaaatacgccaggctgcagagaatgaaggaaatacgccccaacgatgatcgggatgcaatttagaagaaccatcggcacgaagattagctgttatcaggtatttactgtcgaagttataagctacacgtccgaagaatgacataattccccattgagatgcacccgtacctgtattatcccaagatattttattggcagcattcaatgtttgaatctgatcgctacgatagtgggagccattgatccagctatttgaatagtctgaatccgtccatgacgaaccggccattacttccaagccatgtttcttgaagtttttattataagtcaatacattatcaaatgtcagcactgtgttcatattccgattgtccgaagcctcaccatactgattgcggccccaagcagtagaaatcggatcaagaaaagtggtattaacggcgttgcgacggtcaagagtaagagtagacttaaacttcagttccggaaatggagtcagcaatatattacccgatgccaacaagcggttttctttgtctttgttatttttcgcacgggccatattttctaatggattggtgatattacccactccatagaagttattgtaatactgattagggttcaaagcgtcccacaccggcgcataagtcggtgtattgataacagccagaataacaccaccccgattcgagcctgttcccattgctccgcctccattgcttgtataatctgaataagagatattagcacttactgtcagccatttacgaacctgattttccagatttacccggaaattgtaacgcttgtaataagagatgtccaacactccctgttctttgaggtaacccgcagaaaggtaatatttcattttctcattaccattggatacagctacctgataattttgagtctttccggtcgtatacgtttcatcaaaccagtcggtgcgatcgggtaatccgtccggcaaagacactagtccgatttcatcctgcaattctttatattgtgctgcattcagggattctactttatcggctactttgttcaaaccgaactgggctgtcaaagaaactttggcattaccggctgcaccggccttcgtagtaattagaatgactccgttagcggcacgcgaaccgtagatagatgccgatgaagcatctttcaatatctgcatactctcaatatcattcggagaaaggaacttgatattgtctacaggcactccatctactacatacagcggatcattactaccattcattgaagtagtaccacgaacacggatagacatttcaccgcccggcgtaccgttaggctgaatcaccgagacaccggctgccttaccttgaatggcctgtcctgccgaaacgataggccgcatatccaaatccttggtagatacggaagagatagcggtagtcacatctttccgtttcaccgaaccataaccgatgaccaccacttcatcaagcacttcattatcttcctgaagtgtgatcttcatctgttgggctgcctttacctcctgcgacttataacccacataagagaatatcaaaatggcgttttgcttaacgtttaatgtgaagttgccatctaaatcggtaattgctccgttagacgtacctttctcttgtacactaacaccgattagcggttctttttgagcatccaggacctgaccggatgcagtaatttgctgtgcggatgcactcaaagataaaaacattgccaagatagcaaagaaaatcttgcgactccccgaaaggatttttcgcctgttttttttcatgcgtactaagttttaaagttaataataagacgctcgtcagcaatgggctattctcattactttcgaagcacaggtcaaaagtataaagaaattaaagtgagctaacaaggagggggcaataagtggatcacacaaaacgacaatccactcattttcacctatttacattcagaacatatacctaaaaaagtggttgatttacagtccgaattagcgaatttttcgcactaaatcgtcaaaatcctctctcgatccacgggctttattccttactttcgcccgataattataaattgtattcactgaataacgaagaaactccgcaatttgtgaactatcttcaatacccagacgtatcaaagcaaagatgcgcagttcagtattcaataactcgcctttcttcggtaaaatctgttcattttcctgtaataagtcattgaattttcccacaaagttagggaagagatgcaaaaaagctgtatcaaagttagcatacaattcttccagttcttcgtcaagagcatcttgggaacgcgttatctttaataactccgcaatttgtccggcagacactttcttattcaccatccgccggtaagcgtctaaacggttgatataagtagaacacaacttgatgaaacgggcaatatactcttccttgatctgattggactccgagagttcgatattggtagaagacaagcaactattcatttgcctcaactcctcattcaatccgtttaactgcttattagctacctgaagatgatttcttgcatctgccagctttttcatctgacggtagatatatcccaaagctacaatcaacaacaccaatagtgcagtgataagcagcaggttctgttgaagacggtcgttctgcttttcaatcattgcctgataggttttatcaatcaatgaaagcacgtcagcactctgccaactacgcagacgggcattgtagaacttggtcgcattccacgaaaagcgcatatattggtacgcacgttccatatcaccatcttcgtaaagtagctgggcaagcatccacaacgaagcatggtccttaatggcagaacgaatatccgatatagcagaaagacaaagattccgtttctctcccagactatcattactgtacttgtaaatcaaagaacgatgataagtagccatcgcatattggggagtatatggttctattttcgtcaaccgaagatcattcactttcagggcttcctcatactggcgttgatcgcgaaatgatgcttcacgcatcagcaggtattcttccgattccggaggcaatatagcatataatgaatctctatatgcctgcgagatactccaataacgtcccgaaagggttttatcctgtgtataaacgcccaactcgccatacacatggtcaaagcaggtataataatcggctattaaacgaggaatgattttccgacggtctaccgattccagcacatcaagagactctttatacattccagttgatgataataatagcgaaagctgcaactgactttctatctgccggtctgcatcacgcaagcgctctgcaatccggatattttcattcaaatagtggatggcagagtcgcaaataaaggctttatattctttgtatatctgactgttcagattgtactgttccgcggaattaggttctattccgtgtgtcagttctttaaggtgcttgatacgtgattctcgttgaaccacataaatttcatgttcctgaatcgtcaaatcaagcacattcaacagtgagtccaaggtcttatcggcccgggtatatagtggaaaagagagaagtaaaagaaatatcaggtacttttttttcatcggagtattaaactttaatagaagattacaagactaataaagacaaatgtagagaaaatcttcgtaatctgattacaaatggctcataaattaaaggaacaaacagcctatcttaaaagctatataaagtatatgttatattatcatcaataaaaaccagctttactctatcagacaaatccattcccagatacagacctgatgaaaataaataccatattaccaatccaagctcttaccaataaaagtattatctttgttgcatgaaaaaattagtcattgtaggatgtggacgacttgcaggaatcgttgcggatgcagttgtcaaaggcttattaccagattatgacttggtaggtgtctattcgcgtacggcttcaaaagcagcgcacatcgttcataaaatgcagcaacatggcaagccttgcattgcttgcgccacattggaagagttattagcattaaaaccagattatctggtggaatcggcctctcctgccgctatgcgggaattggctttgccagcattgagaaacggaacctctgtcattaccttgtctatcggtgctttggcagacgagacattctatcgggaagtggcagaaaccgccaaggcaaatggcacacgaatctatatcgcatccggagctaccggtggattcgatgttttaagaactgcctctctgatgggaaatacgacggcccgcttcttcaatgaaaaaggtcctaacggactcaaaggaactcccgtttatgatgattccttgcaaacggagcaacgtactgttttctccggaagtgctgcggaagctattcgcctctttccaaccaaagtgaatgttacagttgccgcctcacgagcttctgtcggtccggagaacatgcaggtatccatacaatctacccccggatttgtgggagatacgcaaagggtagaaatcaaaaatgaccaggtgcatgccgtagtagacatttatagtgctacatcggatattgcagggtggtcagtagtgagcaccctgattaatatcacatcacccattgtattctgacagattggccaatacttttgcgctcaggcggtcaaacgcctgacgcgtgcggccagtagacacctgcatacaacgtacatgcggatgattgagcagttgctcactccccaacgcgcctatcgtgtcacaaaaacaaaggttgtcaccttccagccattcagcgaaagctgcctcatcccatgccggcgacaaaccggtattgaataagattttccgattacccatctgcctgaattcctcttcatgcagcagaaccgtatttttattaaggcaacagcaaatgacttcactctctgcaaggagtttctccaacggcaaaaagcaatatcctttggcagtagccgcttctttctcactgcgggcataatatgaaatatcagcaccaaagaacttcaaagcgtccgctatcatgccgcccgacttacccaatccgactattccgacttttaagccggtgatctcacgaggtaactcctcccacgattcctgcccgaagccatgcaaacagcgcaccaactcactgacgacatattctaccactccctcatcaccataatcccggatacctgttaccgtgataccccgttcattggcatagcgaatatcgacattcgcactttcgggagaatagagcgagcaacacattccaatgtatttcacattcagacaacattcaagtacataccggttgatacgggaggtataactcaaaagcaccgcatcggcatctccgatacgggcaatgatttcatcatcactcgcgggtacatcaggatacatcaccacctgaccggcaaatgaatacaacgctttttcggccgacggaaccagactgaccggctctatagctacaagtttctgaaacatcgtttttttattttagaagtattataaaaacaaacatacacggttaccggattagcaacccaacatgggcgctaagatacaaatttctagccataatatcatttaatgatggacgataacagtatgttttagacacacgaacgcaagttaaacatatccaatcagagttcactactcgccatccggttcctttcgtggcagtgctataaaatgcatctgattaccccgtccctcccgcttgataatgccttcggccgcaaaagatttaagatcgtccaatgcagtattcttcaaacgcccggtaagttctgtataagtggttcttgtgatgaagccatgctccccgatatattgcaggacgagtttcttcaggttctccctgtcccacttacatgaagtattgaaatcgacacactttctgcgctccaaatctccgcgaatacctacacgcatactcttggaagcacggaaattcaccccgttgaaagctacggattcagaacgaatatcattcttatttgctaccaatcgggaagctttcactttggctgaaaagaaaccgaactctcccaattcgacgcggtatccttcacccagatatatgattgtaatatgattgcaaaataaaattcatctgccaactaccggacatcggtttctctttatttattcacatagatttgtttatttctaaattatttcagtacatttgcctgacctacttctattacagaaaggatgaaaatagacgaaatacagtgcataaaagaactacgcaacggctcttaccaggtaaatccggaaaaaccagacgtgccgcttaacaaaaacgatgcgtttcaaaaagtacaaaaacgacgcgtacaagaaaaacggtgagcgcggtcctattctacacgaccaaagcccaccgtttttctttcacttgaaccctcttaaaacgaccttaaaatatcatttaaaaaccattgcagattcaaaataattcactatctttatgcagtgttaagctgctatacctgacacttcatccggcttcgtgtacagcatcatgtctgtatatttagcttgatagtttacgcttgcactaaactccactttcctgcattccttgaacgggctgccaacaaatggatttcggtccatccagtcgcacagttctaaaatagaagacttgttcgaggtgaagtacacgaacgaatgccctttcagcacggttagtacatccagatagtcggccagacgccagtacatcttgtaagttcccacttcagtggaaaggtatggcggatcaaccagaaataccacacccggaacatccttgtaacatttgaacacttccttgtaatctttgcaggtaaccataatcccttccaggtaatcttccgctttggaataatcagcccgccgaattctattgtagatggcttctttcttcatttcttccaaactggccacatacttcatggcgaacaacaaggaggctgaaatcgtgatataatccacgtagccgtgctctttttcctccctctcaatacgggcaaacattttatcgcgaacctccccggttatacgtttatttttgggttctccttcagctatccggcgcaaatcggataacagcacattggtggccggaatattcgcaagccggcagcggtagttgtcgaagtcgttatacacaacggtggcatcaggcctgacacatttggtaatatgtgacagcaggcccgagccgccaaacagatccacaaacacggtgctgtccggaaactgtcccagcaccttgataaattccttcgcaaacatgcgtttctgccccacaaaaggaagcggagcggacgaatacatctttctcatttcattctgccttaaaaacggccgcaaaggtccccaaaataaacgaaaaacagcgggaaacataaacggttcccgctgcaagacatatacagcaaactacacgttcagcccgaaacggaccgtctcgtcaccggcaagcagtgcgcgggtacccgggatattgttctcgtagatatgtacatttcccagaaagagggtgatcgacttcaggggaagttctatctgccgtgccatcaggtacaggtggtaaatatcggaaggcagcccgaggttcgcgtcgctgctgcgctggtaggcagacagaaccagttccccgtcatccagctggaactgtaccaaactcaagcagggtgcctgattactttcggcaccagtctcacccagaaaaagcacatagttcttgctgttgcgcttctcccggttgattttcgctatcaatggcggcagcttctcgaaataggtaggataactgttcaccaggatggaaccgcaataatcccaccaattgatgccggcctcccggtacttctccacgttacgttccccctgcatgaacagctgtaactcgctacgaagtttcttgcgggcgatattatgcccctcgaatatgtcaagcaggtccgccggtgtcagcgacaactgttcattcagaaggtattgtatatttcccttcttgttggtctgtgtctttcccgcgacaagaatcttgtccaggatacggtaatacttattcatagccatttcctccttctaatattaaaacaccctaaagataggggaaaacggcgctccaaacggtagaagacaactcattcacactgcaagcgtcttgcagtcactttgaaaccgtttcaccagggcgtaaaccttacgctcgctcaccgaatacttctcggacagtacggccacggcatacgagactttctcaccatgatccagcaggcgggtataatccgcatacagatcgatataccgggcatcttccagacggatgccgaccgcctggagccttttcagcagctctcggttaaagtttaatatctcaatcactttcatacaacaaaaaaattatatctttgcatcgccaatcattttttaaacaacaaaaaaacgtcaaaccgtgacagagggcatttgcccccggtcgcgcggtttggcgtttcatgttttaaaagtgattggcgttactttttaacaggccgggggctttttcttatcctcccccgaaggatttattccacccggtacttctccggatcaaaagcatctttctttttccagccgtcagccagcgtattctggatgtgcctcatggctttcgtatagaagtccgtcagctcctccagtttttcaaacgtccggtaccggggttcgtcatccgtcccgaatttgaacgttaccggaagtgtgacaccaccggtctgtacagccaagtcatgggccgtcttatagttgaactggttctcgcttgacagccacaccggcatgccatcgtaaacaaaaccgcaaagaatagcttcgtttatcctttcgttataccaaccaagcacaacggatcttattacccggtccgagggcttgcccagaaactcctcctccatataggaggcggaaccgtccccacgttcctgcacatcccaacgaatgcgccatccattacgagccgggctcacacattcaatcagttttaccccggcacttccttcaactcttttcatgtaaacacgtatttggttctacctttgccgaaggtttccgtcttgatggtcgtttcaaacggaaaaccgtccggcatttccttcacttgtgcgagaatattcttcatctcctcgctgttggtgaagaacttcttcgcctcgccgttcacttcgatggccacgatacagcggtcctcttcctgttcggtcttgatcccggtctcaaagtccttcactacaatcggtaagtttaccagttcccggatgcttaccaccactccgggaaaacgcttcttgccgtcctccggcttataggaaacgttcaagtctttaaatgatctcatttctttgcctgttaattttttaaacaacttattacagtcggcgtgcttcgtcatgccgtagaaactggcaatcagttcccgccgtctctttctcgattttacctcgtgcatcttccgagcaaacttctgtttgatgcgtttccgcaatcttacataattgggacggataacatagccgagaaaatcaatgccttcctctacaggaaacacccgttcattaggcttgatttccaagtctattttttccatttgcccgtgaataacatcacgaatcttccacaattccgctttcgatttaccgagtaccagtccgtcatcacaatagcgatagtaataacgaatcccgtacttatccttcagatagtggtctaaaaatacagacagaagcagatttcctgctccttgtgagctgcgcagcccgaagctgataccttcaggcaacagcgttacaaaacgctccagcaaaaccagcagcctttcgtccttgaacaccctgcggaaacaccacatcacgaagtcctgccgcacattgtcgtagaacctacagatatcaaacttgtaagcatataacgtgccttccgggtctttttgcagatcggtacgtatgcgattcatcaggtcatgtgtgccacgccttttgatacttgctccggttgtccggatgtaacgtttttgcaggtggcggtccaccacattcatgatggcaaacacagcgatgcggtctttcatggacaggatctgcaaaatacgttttttaccgtattcttcgatttccctctcatggtagccgcccagccggaatgagccgtccgcaatggcagccgtcagttcggcgataatctcctccctgcgggcaagcaggtgtcgtccctgcctcgacctcttacgtccggttccgcgaagtaccgcatcgaatgcctccgacatgttggagtattcgatgatttcctcgatgatatatccttccctgcgcataaagttctgctgtcggttaataaatatggaagataaggccttcctttccccgggtccgacttcttcgaatcacaagtgacctaccaaactccacccgacgcgtgatttttcagctttccaccattaaagtgctgttgctgtggcttgcttcccccggcaccaccttggggacacgtccccattgttgtacgccggtttgttagatttccagacgcgagccgacattcgcattcgcattcgaagcatcgttgttcgcattcgcattcgatacaccgccatttgcattcgcattgttgtgcccgcgatagaccacacggactattgggaaactccaccggctgcaaagttattgatttaacgggcaaaatgaactgacgaactaaattaatatccaaaatagggcggacataataccgcccaccacagtgagtccccaatcaatccagtcccataaaccaccccgaagggcatccttcaattcaagacagcaggcggccaccacggtagcatagatcgccgtccagggggtaaagccaagcaggcctaccatcaaaccgcccacaagatgtttgtagcggttactcgttttaagaaatgtgataatctttttcatataccttgattttttacttttttcgaccggctccgccggtatttgaatactttttaaacggtgttcgaaaaccatccgaatcccgttcttccgttttggtcgcttcgctccacgctttggcgctttacgcttacgctacctcacgtatcgccttgtacgctgccacgctttgcgcccggacgattttgccgcggaaggccagacgcgagccgacatacgcactcgcatacgaagcatcgaggctcgcattcgcatacgatacaccgccattcgcattcgcattgacgcgcccgcgatagaccacacggactgtagcggtacttatccagtacatgtcggtatagtaagtagaagatgatccgttcagattacctaccggaaccatgtccatatacttgccgtgcgccacgcctgtaatccactgaccgctgtccttcttgccctgtaccatacggatactgccgtcaggcatccaaatgcgccatttgccctggttgccgctgtcattcggcaggtccacgccgtccatcatgtcatacttgttgccgtagatgtcctcgtagcccaggcagcagatattgtttacctgcactacggtctcctgtccgtattcgtcccggctcttataccaggcatactggtgaaccaggccgtcaatcagcgaattcgtgattttgttgttgatgacatacgcttcgtcatagccgatggtatctgtcattccatggtcggccgttccacccgttgttcggttgttggtatgctgtccggcaccgcactgttcctgcatgtccctgcgcccataccgtgcatagctcaggttcgcgatgcgactgtgcatcagcgcatctatctgctgcataccccgctgctggctgtaatagtggaagtccgtccaggtcatgcttgccgtggtcgaagctccggttatacaggcacgcagcttactgcccaccaccgaactgcccacaacggcacacagatgttcctcattggccacccaatccggttccatgtcctctatcttgtcgctgttgctcagcaccacgcagtcaaactctgccgtgttcaggatggagaaatgcagggccgttgcacgttccggaacatccgctatcagatacatgccggcttcaaatttcaagccgatggtcggcaccacaatactcttcaggatgtttccctccgcatcagcaaacacactgccgataagccccgtgccgggaacactcgggaagcgcacgcgcctgtagccggatacatccaccttgcacacggaataagccttgtccgtagcataggattccttcagcgtggccttgccgctcatgatcttgcgttcacctagccagccgccctgtatttccttgatggcatccagcgtcagtactgttgcctccggaacagggggcatttcgtcttccgggtagctgctatagcaggcgtacttcttgttgttcagatagtcgttgatgcccttgctccagtaaaacggctcatacatcatccagtcaccctcgctgccgtccagcttcgcaaccgtgcaatcgttcatatcctccgcatcggcatagaagttcgagctttcgtcatgcagggggaaataggttatttcaccgtccgggttgttcacttccacctgctgcccggctatctccaccttccggttcgtgggcatcttggtcatcttggccaatacgcggtggcgcttggacaggatggcattcacatgcccgctcattttgtacgcattcccgaatttatacccggtcttgttgtccaggttcgaaacattggcatcgtcggccacactgtcgtcaaactcgatcatcgtatagggcggctgcttgatggtcagttccggataacgggcggcatacttctccagttcctcatcggccagatacttcgtcagggtcagcttgcccctcagtcccgaatgccggtcatccacggcacccgtctgtgtatacgttccgtagtcgtaatacttcttcagcagggttccgtcgtcttcccggtctatctccagcacgaagcgctccagcttgccgctgccgttcagtctggcctggtgcaggcgttccagcatggcgaacccgtcaatgccggggcagttggtatagcggtagccccgcacgttgttgatgccttccagcaccaggccactatcggacagcttggtcagatattccaggaacagttcctcgatcgtgtccggcaggcataactgcacaacgggcgcaccggtggccagtttcactcgggtcagcccggtgccgcgtacatccagttttttcagccgcccctgccagctcaggtccaaggtggccacgttcccgttgtccccgttccgggccagcaggttgttgcgcatgttcacttcttccagaagcagcatgccgttcgtcgaggccatgaacgagccgttccggtaaccgctggctttctccacgctcatgtccagtttcacaaggctggtcagcagaccgaagttgaagccgatggcgaacgcatcctcatgccataccagttccttgattttggctgcgcccacaatcttcagcgggtcgttctcaccgaaggcacgggtcagctgcagggaatggagcacgtccgcatccaccacaccgctgtcagcctgtacgccgttgctggtagataactgcacacggtacgggatggtcagccggtactgcatcggcttcagtttgtatgacttgtccagcgatgccgtactctggtagaactgggcacccagcgtagatacatagccgtactccacctgcttcaggtcgtaccggcgctgaatgaagtagtttcggtgcgctttcaatgaacccttcagaccgtaaatctgcggatacgtctgcttagcaccgtccgcacccaccggcatctcgttcaagaacgggtacacatacttgaagagtccgctcttattgtacaagcgcgagcaccacttcttcatctgctcggtatcgaagtggtcaatggctttctggatactgaaggcactcatgaagctggttccgccgttcacgcccttggtcatcacttcctccagcagattgcccatgttgcccagtatcaggttccacagccagctgttgtggccctgcatcacataggccccgtctcgcttcgtctgccggttgtcgtcatacttcccggtcaggaacgacttgttgtccgaacccagctggcagtcaccgtcgtagtaggttatccaccacatcacaccgtcccacgtccgcaccagcatgttttttgccagctggtccacgcccaggttgaactgcacatacaggtagtacgcagccaggttgggcaggttgaaatacttccccgcttccttcctgaaggtcgggctcacccatttcgcggtcgggaacctgttgccgtcatcctcatagtccaccccgtcaaacgtgtgcgactccctgttataggtcagattcttgccggcaggcgtttccttcacgcatctgtacaggaagcccatcatgcggtccagggccttgtacatcttgtcatatttgtcaccggtgcccaagtgttccttgatgttcggttcttcttcggcatcgccaccgccgtcgttccagaacacgtctttcgggtggttgaactcgaaaccgccgtcaaagttgaaatccatgaagtccctatggtcgggctccgtggacggcagccagcggaacaggcacaggtcattcgagttgttcagcgtctcgatgcagatgggcaggtattccttcggctggtcgccgttcgcctgcaggtagttcagcgtgtcgccggttccccattgctcgccgccgatagtcttgtcctggccgaatatcgggtagctgtcgctcttctcgttgttcatgttatactggccgtaataggtcaggtcctcatccacgctcttggccacaaacaggtcacagggcaagccgtcaatggccgagcgtatatcttccttgcacgtatctgcatggtcggcggcatactgttgggcaggggtcaggattcccatttccttcatgccgtcatgaatgaacttcgcaccgcccgtgttggtcgtcatggaggagtcggaaaagtcacatttcgcacaggcaagtttcgcgcccaccgagttggcccgcagcctgaacaggttcttcttaccctccgtagctgtcgggttgctctgctgcccgttgccgtctatctcgccgtaggtcatccgtgccgtatatccgctggctgtcttctggaagtagaagcgcaggttcttgcgggcatagttcaccgaactggtaccctgaatacgcagatatatgtcacgggctatccagtccagcgcccggttctcgccgttgtagaatctcacttcccggcacagtttgttggccttcttgttgttcagctgggccagtgcatccatcacgttcagcgtgtcgctctcgctcggcacctcactgcccacgctgcccgtgcctatcagtaccaggatcgagttccggcgcttcttcatcagccccatcagcttctccatgctcaccgtgtctccttcgttcagcacgcggttgtcctcatccagcgagcgcacgcccggttccccgtcggcatcctccaggtggttgcggtccacgatgtagttgttcagcacctcgtccgaggtcagcgccttgttatagatacgcacgctcttcacgttcaggtcggcacctgccgacttaaattccagctggctctggatgtcaaaattcaccttgtcgagccacttggaagcagccgactcttcaccgttcacatagaaaccgatcagcgtgcgctgttcgttcgtctgcacgttcggatagaacacgtaggtaatgcggatattcgtgcccggctcgaacttggtacccaccgagtcttcatagcgcagcacctgtccggcatccatcgcctcggtcaccacaccggtcaggaacttggcctcttccggagtcacaatcagcccgtaccggttgccgttgtccagctgccccaggcaggtgatcagctccgcattcgtgtccgtcacgttggccgtgctgtattctatctcaagtgtcatgcccacatcacgaatagcaaagccttcgggtttgtccgcctcgttgaaggggcggtacccaccgtcagcggtcagggtcatacctgcaccaccggccagcagcaggcggtccttgtgccagccgctaccggcaccatattcgttcacgctccacagcacgtcccggaactccatgcgcttgtcaccgctcacccagcttgccgggttgttttccgtattgcttcgcccgaaggcatcgaacgtgcacacggcatccggtgccagcgtggcttcaatgtctgggtgcgatgtggtgttcaccttcacctcaagcacggcatcaccgcacgacacacgatagtccagcggttccacgttcacgttcgtccgtccgtagctgccggtctcaccgcgttggagcaggtcttccttcacaatgctgtccccattcatcaccttcacacgtgccgtgtacgcatcacgctcgtaaccggcatacgtgaagttccaggcagtgaactgctctgcctccagcaccgggtgtttccagtcacgctggaaacctgctgcccggtggctgaacatcatgccggcatacgctgtaaccccaccgccggccttcagaagcgtaatgtaatgcacttggcttaccacaccggagttctcatgctgcgcgtaggcttccaccacgttcgcaccctcctgcatctgagccagtgggatggtcacgttcttctgctgcacaccgctgccggccgaaagaccgagggtaaaggcctgtccgccgttgatgcggtagtagatgttcttctctccgctcgtacccttggctgtgaatggaatgttcacatcatttttatatcccccgtcggccagtccgttacccaccgaataagtggtacttaattccatagccaccattgttacccgggctgtggcggttttcatcagcgtgccgccctggtaggtacactgcgcttcaacctgcaccgtataggtcgtggcatccttcaggtagggcgatgcgtcaaaggtataaccctgcccggcggtaacacccgcaaactccgcatcctggaattcggtaatcaccgtggagccgcgtttaacaaccacttttgccttcaggtcgctgtaaccgtcaacctccgcaccgccggcagtaccgacgcttaccgcatattttaccacgaaccaggtaccgagtgccaggtactgggaggagggaagccccgcaccgctgctgtcagtcaggtcaatgttcaccaccaccttgtcgtcgtcggtgtactttgaaaagcggacttccttcgaactttcaccgcccttgttatctttctgtttcacggtcatcacgtactgggtgccgtcctcgctgtcctgcacatccacgtccgttaccgtgccaaccagcgcatcgaacaccgctccggatgtaggggctttcgtttccccgctcaccagttcctcggtaggcgtggctttctcgtcaatgctcttcacgtaattttccaccaggcggccgcttacgggcagcccgccggttgcggcgtcaccgctccagttcgtatgctgcatgtccagcccgtcctggtcatataccttctttgccataatatatcgctttagtcattattcatttgtttcttcgccacccgtcggtccggctccacggcttgtcgcctctccagaacccgctgccgaaacagctgcttatggcagaccacaccagcctcgctccggcatagacggccgatagggaacgtttccccacatacacagccgttatttccttaccgcctattgctatcatcgtcactcctcctcataaatcagatacagcgtattcgcatccttgtcctgtagtgcttcgtaagtttcctcgctcatcaccgcatggcgataggccagaagtttcagaacgcctcccgttccggtatatacggcatcgccaagcaggtaaagcttgtccggcagtatggctgtccggtccgcatccatgaacataccggcagggggtacacccgctacatcccagtccccgtaaagggtggagtccatattataggcgaacttcccggcatccgccacatacaccacgctgccgcccggcttggtacccttgtcaggtaaaacgtttcctgtttccatccatgaggaaaagcgtgcagtagccccgccgacagctgctgtcgtagtctgttccaccttgactgcggcattttctgccttggttgccgcttcgttggccttggcagcggcttccgtggcggcctgcgtcttttcctccagtccggctacagccccttccgccttcttggcggcagcctcggcacgggcggcggcatcgctcgcaggtttcccaatcagttccaggggtacgttcaccatcttgccgtccttctcaccgggcagcgatttcacaccgctcagcgaggtgacagtctccagatcctccacaccggtagaagattggagtacacggtccagcacttcctggaccagttcttcttgtgtcatttctgccataagcctatccctctatcagttttacaacttgtgaatagcaccccggggtaagcccggaaaccgcttcctttatcaataccgcgtcttccgccgttatatcaatttccccgtcggcatccattatctgtatgcacaggcggtatgcccgtaatttcttgtcggcatccgtctgctggttgccactcgggcggatccccgtcccgttgaacaggcattgcgctacaatacggccgacaatttgcatctcaccattgatctgcaacggcaggccgtcaaaatccttgaaactgtcataaaaattcactttcatatctcaaccgaatttgttatatgtgtgtcatgcccactacaatgccgttaaccacctcaagattgtagttcgtggacatgccgaattcaccttttatagtccatctaaaatttccgctcacccctttcctgtatgtataagtaccgtcactgccaagcgtccagcccgtgccgtaattgttcgaaagcatatcattactgtacacggcaccgttcacatggacgccgccgtcaaaatatccggcataggtgttggcacttatcggataggtcagcccatccgatttgctggaggcatagatggcggcaccgcccatattggaaccgacggccttcactccgaaccgcccctgggtggccgcgttgaaagccacatccacgatgccttccatatctgactgcgacacgccgagtttcaggctgcgcgagtcattgccgaaatagtcaccggctttccagtacaaccgcccgtcgtcaagtgtaaagccaccgatcttcccgtcatcggcatatatggttccgtaaaccttggcattccgggtttcgatgcttccatccttgagtattttgaaatatccgttggcggtgaccgacccctccagtataatctcgtcaccggtaagctttatcttgctgacgctcccaccgtccgccccggtcccttccacgctcacaccgataagggccaccttgccggtgctatcctgcgcgtacaggccggagccctccggcttgatcaccagcccggtctctttcagcgcctcaccgtccttgtcgaacacggcggccgaaatcttcaccagccgctcgctctgctcgaacagcgtgcggtacttataggccagtgcgtccgccttgttggtgctgaacaccagcagcgaaatgtaaatcacgcccgtaaacgacagcttgaagtcgcccgtgccgttccatagcccgtccagcgtgaacatcttctcaccgcccacgggcagatcttcttcatggccgaacatgttgaagttctcaaatccggtcttgtcagcacccacaaattctattttcaaccttccggccttgataacccggtagctgaacgacagatacaccacgccgggcacccgttcgccctggctgttcgtctgccggtactccggtaccagacggaagtctttcagtctttgcatgatgtaattgttccggatataggcataaggcaccttgccgtcggtccgtatctcggcatgcccgtccggctttgtgccgtaagggcctccgttcgcccagatccagcgtccgcccagggtgaacagcgtagccttgctgcccgtcttccatttgtccatgccgtcggcaaaactgctgttgtccagatagctctggtcttcgcgtatttccttgcgcaagctttccacggccgaatggattttgccttcggttatctcaaaccgcgtcaggatgtcctcgccggtcatcagcacaaacgtgcccttcagccacacgttgtcggcatacaggccgtttcccttcggttggttgtctgccgggaaagcgctgctcttgatgccgtccagcttacccaaccgacagcgcaggcagccgttgaagttcttggccttcaccccgtccagaatgtcgatacggggctgcccgtcctccgtggccgctatggagataaggttctgccggagcgggttttccgtgttgcccatcagcacgcactcatcacctgcctccggcttcaccccgccaaactcgcttaccgggaccagtaccccgttggctatcaccgaggccacctccacccagtaggattttagccgggttccgcctgtaacggcacagcgcatcaggtcatgggccacaaaacccgattcctgctcaaacacgatgcggtagttgtcgccctgcttcaccacgtccttgatcttgccgttggctgccgacaccaccagctgcccacacacgctgcggaccttctctatcagcagttccagtgccaccaggctttgccgggcagtcactttgtccaccgtcaggttcgtcaatccggtcagctggtcaatccagagttgccagccctcaccggtcagcccgtccacaaactccgtgctacgcagcagttcgcggatcacggcggtcaggtactcggcattgccctcaccgtccacgctgccgcagggcttgccaccggaagcctcgccaaatgttactcccttcagaaagcggatgggttctttggccgtatccggcttgctcttgttcaggaactctttctggctgcgcctggctgaaaacaggttgttgtccgtgggcaacgtcttgtcccaactccgtatgatgtccggaagggctgcgccttccgtctttgatttcgtataactcttcagcgcaccgatgctgtccgtcaccttgtcaaacttgcccacctgcaacgcatcgcttatctcgatgtccatctgcccgggttcgttcaccttgcggctgattctggtgatacggctctgccggtagcctttttccggaaaatacttccggctctccagcttcacccgtcggcccacaaacaggtcgatgccgtgctcctctatatacacagggtccgtcggggccttgtaggcggcaatgtccagccagtactccttgttgtactcgtccaccgcaaccgcaaactcctcttcggccagccggtaatactcatccggcatccggatgttccacaggatataggtgtcgcctgcccgcggcaccagcttgccgcccggcagctgggtgtcgtcatcgtagggccagatggtgatcagttcgaattcacgtgccgcgctgtcgtagttcacctcaaaatagtggtcgtcactctccccgagtccggccaggtcgccagtctggaacgacacacgttttgtctcacccgccagctcgtactggttggggtcaaagtccagttccccgtcccggaaataatagacggtgaatttgtttccttcatcgtctgccacctcctcgctgcgaaccgagctcaccgtaccgacccgacgggggaagatgccgctgaaagcatcctgctcgtaatggtcatagatgccgtattcctccacgccctgctcgatgtacttcctgccgccgggaagcatcagacgcgggctgccgtatttctccgcatcgatgttgcgggtcgagcctaccgggaacaggcgcgtatagaatttggccgtgttgctcgtatctctttccagggaggtcagccccttgccatagccaagggtgatttcttccccgtgctcgcagcggcacacgttcacagtctgcccctcaacccaccattccaccttgccgcctgccttttccgcgatggctttcagcgcttcgtcgcagtacatcccctcgtagtctatcgtaatcagctccgtaccttccaccgtacccgtcttccagtcggtaatgtggcccatgccgtcattgatagccttcaccaccatcgccacatgctcgcggggcgtggccgtcagtgtaaacagagggttggtgtccccgtctgtcgtttccagcaccaggaaccgtttgatcaagctctccacaccatacagcttcaggtcatagtcccattcacactcgttcacctgcttgggggtgtagcgttccgtcagccagtaccgctcgcccagataatccgtatagtcgttcacgtcaagggcgatatgttcgtaatgggtgaaggaaagggacaggacattctctccctgaacctccttctgttgggtggagctgtcatccggagcgatgtccgcacgtttattgccgtttctgtcatatatggtcagcatgtccgtaatcctttaaatatcgtttgaactgcatttgaatgtcgttaaatcaccggtaccggctcgcggaacttcactttgaattttccggcatgcacaccctctttccacaggtaggtcaacggggtgaacttcgtgcagtccgcatatttgacacgaagggtcagctcaagctggggaaaagaaatgtcgagccatccgtcccggcccttcttcaggaaattcacgaaagcgaaataccgcttcatccatcccgactgtgtccgggcgtacagggcaaagtgcagcgtcacgtcgcgtgcctcgttcctcggggtaagcacggcgctgtatttttccccgtgctcttcccgtatgtccacggcagtgtccttcttcgccttgctcggggtcagaatggccgtcaggttctccatgccgccgcgccggtcttctaccagaaacacgccgtattccgtccagatgtccgtgccgttcaccagcaccagtccgccaagtatatccgccatatcacttcacttttagtccgtcacgtatcattttccttatctcggcctttatttcgcccaggtgccccgcactcgtaccggtatgttcatcgatacgggcaagatacccctcggcggtgttcatcctgtcgatgacgctctccatcttgtcatcgatgctcgaccagtgttgcagaccgccggtgaacatgccctccagcttcgtgccctggtcctgcgtcatagccgtaaagccgccggccttcgcgctctgggacgcgccaccctgctgcgtcttgtcatagcccgtagccgccgccagattgtcacgcagggcaagggcttcatccacatactgcatgtactcatccatcagcgcgttccgttccgcttcggtcagatcgttgtcctccatcgccttgccgaacttctcccaccagcccttcagcttatcgctgtacagctcgccgatcttgttgctcagcatcgcacgcatgaagtattccgaaatgtcctcagccgcatccctggcaccgtacttcatgttcatcaggttgtcgatgaagctgctgtacataccgtcgaatgaaataccggtcagcccctcatacagctggtcggtcagttcctccagcttgccggcctggtctatatagtcatccagcttctcggtcagtcgcccgccgtagccgcccttgccggtgtcctggatctgcgtccacatgtccacgttgctgcgcagcgccttcatctcctccgggctcaggctccacaggttcccgtcccactggcgccctatctgcccgctcaatttgtcaatctgtgcctggttgaaaccgccccagtagtagttccaggaatggtggctgccatggtagcctgcctgcgccatagccatctgtaggtagttcgaattcgtttcctgctgcatcttgtacgcatcgcggtaagcagctacagacttggtacccttgctctgcctgatcgtgtcggtcagatcttcgatagaagtctgaagcatttcgttccggttggtcagccgctccatggtggcctgtacttccttcgcattgctgccgttccagtcgatgataccgcccaggctgaacacctgcttcaccgctccgcttaccgccttgataccaccggtaaggatactcatcggttttgtcaggtctatgctttccagcccgtccagcgtctgccccagaccctccaggtattcgcccatccattccgggggatcaatgccgaactgctccgccagtcccagcaaatcctcggcggctcccacgtattccttcacctgtcccacgctgctgtgcagagcgtccgtggcttcggccaacgctttctgtttcgcgttccgggcggcatccagggtcgccttggcattcttctgctcggcttcagtcccttcttccaccgccttgttgtaggcatcctgcgcttccttgacggatatagtcgcagatttcacctgtgacatggaggtcttcaacgctgtaaaaggattgcgttcgttcagttttttgtcgatcgaatctattgcacggaccaggtctttcagactgtccggctgtagttccttttgcgtgtcgatatattctttcagccggattctaagggaccggagactttcggtggacaccttgtcgagatcaccgaacacggcttcccagtccagcccgtccttcagttccttcatatcgaggtcggccgtcttttttttcagttcttcctgaagcgttttccgctcaccttccgtagtagcttccgcgatacgtttctcatattcctcagtaatggccagcttcttttcttcgtagctgccatattccgacaggtaatcacgcatggcctggtcttctttctccttttcttgctctaaggtggccgcaatggccgcactcctgttcttgtcgttggagtcacgtgctccggcaagggcatccgcctggccgggagtcagcccgttcccgccggtggatatgccgacttccttgttttcccgtttccaggcggcttcctgccggtttatctcttctttccgtgcgttatagtcatattcgatttgtgccagtttcttttcggtaccgtcttgcatgcggtctatttcctctttccggttctcggcctggagcgccgcaagttcctgcgccagcctgcgctcggtggcaagccgctgtttggcttccgcttccggattcttaccggactgttcggggtcggcatgtccgccgatatttcctttcttggcggcttcggctgctttttttgcctcttccctggcttttgccaggtaagcttcacgcttcgcctctgcctccttgattttcgcatttttgttagcctcattctccttgtccacttccgcatccatttcttgtggggtaagcccgacacgatgggctcccattttggccataaagcggaaaaatccgccatgtgcgccttccacttcgtccggattctgggctttggttttattcacctcctcatccgcttctgcggctttgtttaccagactctgtacattggcctgatgaagcaatacctgtacatagtcctcgctcttttggataagggtatcataccactcggaaagagttttatagtacccgaaagattccccgtatttgcggttcagttcctccaccttagccttttcctgttccttgcttccggtgaagttctttatttcatcgataactgatttgagctcgaaacgggtacgcaccatctgggcgcggccgctcttttctatctcggtcatttccttcagcgagatgttgaattcgtccacaccctttttggcactgaacaaatccttcgtccattcccagatttcgtcaccgtacatcacaagcagcatgatgccggtggtgagagccgtctgccaggaaaagagggaggagagtacctgtttccataccggcgtgcctttcttgcccgacttttgcaactcgtcgtattctttccgggcacgggcaagttcgtccgtaaaaatcggaaggttattggatatggccaggaagaacatctgcggtcccatggccaaagagggcatttcacgcgccatctgctggatactgttgtgaagcccgttgaactgccgctgtgcattgggaatatccggaggcgtaacctgtacggattcagactcctcctgcaactgcttcaacttgccgcgcaattcctcaagctgcttctccaacgcatggatctgcgcgatattggcactctggtccagattgggggaagccgtctcaccggcaaggcgcagcctttccagctccgcctccagcagactcacggtattacgaagttctagcgcctcacgtccggccttgtccatgccgggggtaaggttgtccttcatcaaaaattcaatctctacaggtttgctcatttcaatcggctttgaaaaaatcctactatatcacccgcttcctcttccacgctccttcccgcaccggaagtgccggtaccgcccgaggtacccgacttcttgcgcttgtagcggggtgcgtcagaaagcatcataatcaacgtctggtagttcacaccgtccaggatgtagtccacactccaaccggtcgcggtcgctatctgccacacgaagccgaaggggctatgggaaccctcaaaacgggtctttaactccccttccttgcacggctcagtctcagcttcgtcggattcgcccgctccactgatctgataatacgcataaaatcctctgtccccagcaggtgctcgaatgtccggaaagcggccatcaggtagcgccattccacgaagttacggagacaccatgccgtcggaccgataaggaaatgccgggacagatagccccggcacaccgtataggccagcaggcggcttaccgattccgtgtgttccacgacaaaggcagctcccgcttcccggtccagccgttccggatccgaaacttccacacccatcttcaggtactcgcgggtcatcagaagcagcccgcgcatccggggacgtttcattgtgacccggaaccggaccggtttctttgcccacggcagccgccactctttcaggggaacggatatacccgcatcgagcagggcatccgcacactccttctggatcagccttaccacctcaacttccatacgctactccttttcagtattggcacgggccgcctgtgccgcaacctgaaccgtcggcagcttatattgtttccactcatcgggaacggcttccgtatcgaacaccccataaggctgggaaccgtcctcgggcatagccacttccagagtacactcgattttcgcagtttcagtaagtgtcagcttgccggcaaggttggaaagaagcgtgccgttcggtatcagtacgctctgtccggacaccagggagagttcccacggaccgtccatcagcacggccgatgtaggagcagtccagcccacaggagttttcttttccgtatcctccttcttgtaatgaagggagcccccaagcagtttatgaagattctcgtagttcagctggatgacattgaacgtgggggcgatgctgccgttcgactgggggataatcagcaccggggttcccggcacctgctccgcgtttatcttggtcgattcaggtttaaccccgcccatatcaaacgaaccgggttcgatgtagcctaccacaaagtccttgtatttcacggcaccgaggccgtacataaaattcttgttcatcgttttttcagtttcattgttaataacataccgacaagcaggccggcaaccattcccagaataaacacccgcaccgggttcggagggcgtttttcctccgtttgaacgtcatttgaaatttcgctcttggtctcgctgcggatacgtgtcagttccgactcataccacagcaccagccgttgcaagctgtcacaggtggccgtcacgacaagggtgtcgccgcgtagcgccacaccggctccggcacgcccttccttgccatggaaagaggcattcgggggaagtgaaagaaggtcaacaaccggtattttcagcttcatcactgattccggaatgcccgccatcaacagccccgcggatgcgtttctttgactgtccgcgttttggacggaccgggtcgaccggctcgtccgatccagggttctggatgtcccgcagctcataaagcacaggacagtcagaacggtactcgcaatcattggcaccgtcaattgccttgcgaagacgtgccatttcccttcttgtcgcattcagttctttttttaacggttctacaatattttctatcaggatatgcgtggccttgtccacgttgtcgatacgtaccgtctcggcggcggcgttcgctttcctgacagtaggcctgatcgttatcagggcagtcagggcggtagcaagaccgccgcccagaacaaggttaagtatctcactcaagtccatgcacaaatcctccctgaaaaaaatgcctatttacctcctgcctttttggcaaacaggccgataatccactgtacgaaacccgtatcggcaatgccgttcgccacaagggaggacccgagaccgtacaggagtgcgatataccattccacatccgccacaaaacccgcgtcaagccaccacaggagcatcacggcaacaataccggtaagccagctcacaagctgcgtccagatacctgacatcttgggaaaaagtttcttgataccttccaccagaaggacaataccgccggcaaagccggcaaaggtcgcgattatcgcgtcataatccgtttccggagtcaatccgtcctgagcgaaagccacggatacgaatccgagcatcaatgcaaaaaagaataaaagtcgtttcatctgtcttttggtttattggtttatacctattgattcaagccattcctgaacatcgaaactggggcaggctttagccgccagttcgttatgacccacaatgcgaacatccgggaatctacggtggaagtccctcacatacttatccagcgccttcttctgacaagccgtgcgagtgtctttcggggtcttcccgtctccggccactcccccggcatatactatatgacggctcacactgttgtaacctgtggctccgttggtcacttcccaagggtctacctgcgcatcctcgttgttgtccacaagacgttccacgcccccgttcaggtgaaacaggtcggtatagcccacctgcttccatcctcttcctccctggcacaccggagaagtatgccatttacggatgtccgccgaagacacctcacgcccctccggggtggccgtgcagtgaattaccagatacttcaactttcccatgcctacgcctcctgttttgcctgactgacggttatcttcacggtcttggccttgtcggagtccagcgtcagggtgacagccccgctcttgtccttgcccgtcgtattggctgcggcggagatacggataccgttatccgtcggggacacagtaaagcccgcaggggatgcgctcacgctgtactcgccggaggcggtcacggcaatatcctggcttccgccttccggcttgatagtcacctccgtcggatcggcggacaatgtcttctccgcaggcttgaataccggggacttgcgggtatccagaaccacgaactcctcgccgaatgcgatattcgtatccgccttcatcagaagcttgaaaaaataaagttcgctggagttcatccacttgtcgatctgaattacctcctcgtcatcctggaggttcacaccggcgaacaggttgccgtcagccgacggggaacagatggtggccacaatcaggtcatcgggccaggagttcagcgtctcgatggtgatgcctttgtaacgcttcttgttcaggtcggtctcgctcgcattcttgtattcgcgttcggtcagttcgttgtcatacttgtcgaagtcatcgatactcatcaggatacgcaggttcggattctcacgcaacgctttggggacagctgcacgtaccgccttcagtttggcaagcatactggacgtgtcggaaggtgcggacacgacaacaacctccgtatccctggctgcctgtgtcaggatgccgtcaaaaaggtggtcgtcatcatcgccgaactcaccgttgatataatgccatccgagctcgaacttcacacttttgctgagttcgtcaagcagagtgttctgcgcttcaggcggaagctcggagaacacgaggttgcccttcggttgccacttgcgccagatatgttcgaacgcgcgcgggttgaaggtggtgaacgccatgaagtcctcggggtcaagggatttctccgaatagttgaaattacctttcgagtcctccagtgtagggttctccttacgtttctgcaacatcctgccggtcttgatacgcggcagactgattttcttctccactccgggaataaccatgatcagtcctttttcgacaaggtcatttccggtggtggcaagggtcaggatcttttccagcacctcgccgttgtaattggtgtttcttactactattgccatagtccggttctattatttacggttcaacttttcctgaatttcacgcatgcgcttgttccacgggccctcattgtccggttccgtgcgcacatcagtcatgaccctgcgtttgggagagagcttctccagggccttttcactgttttcacggtccttcgccagcaggttctcataaatcgggcgggtggcggcatcaatacgcccgtccttctcggcggcgtccagcagctgcttgcgcgcggcggcatcatccgcctccgctttgtcctggaacaccttcagctcacccttaaggcggtcgacttccgcattcagggagggcactttgccggcttccgtctccagaagcccgatttcacggaggaaatcatcgtccgtcgcacaattcgtgaagcgaggacgtttcttgagttcgtctaaattcatgtcattctcgttttgtggctgttgcagccggttattgaatatttggaatacctgttcgggagtactgtcctcaggcaccgggtcagcgtcataaataccgtcaataagcccaagcgccagcgcttcatcggcacgaagccagtgatccctgccgtcaaaatacatcgcgcggatttcatccttggccttacccatacgggtggcatacatctcgcaaagggtatcctcaagcgcctcgatctcacggatgcagttcttcatctcatccttgttgccgtaacagccgccctgaacactgtgaagcatcagacgggcgtaacggctcatctgcacgggcttgccgcaaagggcgatgacggaggccatgctggcggcgattccgtccacgtaaatggtaatgtcggccttgctgttcttcaaggcattgaaaatggcgatgcccgaataaacctcaccgccgttgctgttgatgcgcacgtccaccttcccggtcagggcttccgcttccagaagctcacgggcgatatcaccgctgcgcacaccatcgccatactcgccgatgtcaccataaagaaggatgcagcaggcatcggtcccgggtatcatattgaaaaatctactcatgtcactatcgttttggcaggtccttccctgcaaagtttacggtgcgaaattagggggattaaaagcctttttcaaaccgcgttttcatcatggagattttaaaggattgccatgacgctttaaaatgtcatcatgcggagcgtattttttttcgctccttttccttatcaattttgcacgtaaaaaaggaggtaatatggccgaacttacaaacgaacagaaaaaggcatgggcgaaaacgctctatacccgagagacgctcacgcaggcggaaatagccgagcgtgtgggggtctcacgggtgacggtgaacaactggataggcaaaggaaactgggagcagctgaaggcttccataaccatcacacgggaggagcagctgaagaacctgtaccggcagctggcagaactcaacaacgccatcatgggaaaaccggaaggggaacggttcccgaacgccgcggaagcggacaccatttccaagctgtcgaacgccatcaagaaactggaaacagaagtggggctggcggacatcatctctgtattctccgacctgctcaaatgggtgcggacctacgattccacgcaggcgaaggagatcaccccgcttctggacgcgtttgtcaaatcaaaattatcctgacatggcaaaaaaaagactcacaacacaggacaggctcgcgctggacaactggaacgagctggtggcatccgtgcgagaacattcggacatcaaccccacggacacggaaacggaaatcagacagaggcgggaaaggctggagaagaacgatgaggagtggttcaaatactacttcgccatgtattgcacatgcgagtccgccgccttccacaagaaagccaccgggcggatgatgaggaacagccgctggtacgaggtaagggcctggtcacgcgagctggcgaaatccgcacgctccatgatggagatctccaaactggcactgacaaaaaaaatacgcaacgtgctgctgatctccaactcggcagacaatgcggaaaggctactgctgccgttcatggcgaacttcgaagagaaccagcggatcatacaggactacggacagcagaaaaaaccgggagcgtgggaaaccggggaattcacctgcatgtgcgggtgctccttccgcgccatcggagccgggcagtcaccgcgcggtacgcgtaacaagaacttccgcccggacttcatcctggtggacgatatagacaccgacgaggagtgccggaatccggaacgaatcaaaaccaaatggaaatggctcgaggaggcactgataccgaccatgtccgtatcgggaaactaccgcatcctgttcaacgggaacatcatcgcgccggactgctgcatcaaaagggccatcgaaaaggccaccgaactgaaggcgaaaggaatcgggcacgtggatatcatcaacatccggggaaaggacgggctgtccgtatggcccgaaaagaactccgaggaggatatagacctcttcctttcactggtgagcgcggcggcggcacagaaagagttcttcaacaacccggtagtggacggcggcgtgttcgcggagatcacctatgggaaagtgccggcactttccaggttcaagttcctggtgatatacggggaccccgcaccgggagagaacaagacgaaaaaaagttccaccaaaacggtatgcctgctcgggaaactcgcgggaaagctttatctgataaaaacgttcctggacagggggctgaacgcggaatttgtagagtggtacatcaagctgctggagttcgtgggcgggaaaacaaccgtgtactgttacatggagaacaacaagttacaggatccttttttccagcaggtattccagcccatcgtgcggcggatacgcagggaaagaaaaatatcactgtacatcaccggagacgaggagaagaaaactgacaaggccacacgtatcgaggcgaacctggaaccgctcaatcgggaggggaacctgatactcaacgaggctgaaaaggacaacccgcacatgaaacggatggcggaacagttcaagctgttcaacctgcaactgacctatccggcagacggacccgactgcgtggagggagggaacagaattatagaccgcaaggccagacagtcggaaaagcccgtcattgtcacaaggaaaagcacgcggtcgcaaaacaagtacagagtgtaaacttcaatacctatcattatgagcaaatttatagaactttcagactacgacgcgagtatacaccgcgagattctggacgcactgacaagggaggacgacgccgtcgtggagatatgcgaggaccgcgccgtcgccgagatgcgctgctacctttccagacgttacgactgtgacaaaatattcacggcaaccggtgacaaacgcaaccagcttgtcctgatgatggccatcgacatagccgtgtaccacatcttctgtatacataacccgaggaacctgtcaccactgcggaaggaacgccacgaaagggccgtcaaatggctggaagccgtggcggccgaggagatatcggtggacggcctgcccctgctgtccgaagagacgagggcggcaaaatcaaatttccttatcaaaagcaaccgtaaacgtgtaaaccattggtaatatgagcaatagaaagaaaggggccggaaagataacccaaagcgggaacctgccgaggcccgggcagaaaggacccgcaaccatcatactgacacagcccagaaggttcggtatagacatagcggactacatgctcgcggtaagggctttcgagaatgtggactactccagacggttcaggctgtacgacctgttcagcgacatactcatggatacgcacctgacaagtgtcattgagaaacggaagaatgccgcactggcatcttccatagaattccgcaggaacgggaagccggacgagaaggtgaacaagcagatcaggtccccatggttccggaagttcataggggacatcctggacgccaaattctgggggttctcactcgtgcagttctaccgcaagggggaatgggtgaactacgacctgataccgcgcaaacacgtcgatcccgtgcgcaggctcatactgcgacaccagacggacaccaccgggacgtcctgggacgagtacccggacctgttgttcatcggttcacccgacgatcccgggctgctggtgaaagcagccatctgggtgatatacaaacgtaacgacgtggcggactgggcacagttcgcggaagtgttcggagcgcccatcagggagtacacgtatcccacggatgatgacgaggcgcggcagaaggcgctgaacgacgcggacagcaccggaagcctgtcggttttcgtgcacgcggaggatacggcgctcaagctcgtggaagccgcgaacaagacagggagcgcggacctctacgacaagctctgcgagcgctgcaacaacgaaatttcaaagctgttcctcggaaacacgctcaccaccgaagcatccgacaagggcacacaggcattgggaacagtacacaaggacgtggaggagaaagtgacgctctccgacaggcaggacatcctcgacgtgctcaactatgacatggccgacatattcgcaatgctcggaatagacaccacaggcggggagttctgctatccggaaaagaagcttatcgaaccggagaaaaagatgtccatcctcacacagctgcgcacgaacttcaacctgccggtgggggacgactacctctacgaggaattcgggatcgagaaaccggcaaactacaacgaactaaaaaaacgccaggaggagaaagcggcggaaatcgaggcggcgaaggcccgagagactgaaaagacggaagaggatgaaccggatccgaaagaagaaccggaactggaaaagcacggtaaaggaacacccaaagaaaagaaaaacgcccttaaaaacgcgtacaactggctgaaacgttttttcgggaaagccccggggagagacggggcagctttagaatggtgatgaacgacctctacagaatggaggacaaacaggtggaaactttattctcgttcgatgaagaggtactgaagaaagccctgaagaacatctacagcaaagacttccaccccctgacggaaatcgaggagaacctgttcgaagccacatgggaaacaatgaacaacgccacggacaaggggtttgggccacggaaacccgatgatccggattatgacttctaccgagaaatccgaatgaacaacgccgtgttcgcggctttcaaggtacaccgggcacaaaacgacatggcagcgctactgctggacgaaaacggcaaattaaggccgtttgaacagtggctgaaactcgtcatgcccatagcggaccaccaaatggtagactggatgcgtacagaatacgacacggcagtcatacgagcgcatcaggcggccgactggagacagttcgagcgggagaaggatatcctgccaaacctcaaatggatgtcgtccacatccgtacacccgggagcggaccacagaatattctggggaaccatacgccccgtcgatgatccgttctggaacgagcacagaccgggggatcggtggaactgcaagtgtacgctctcgtcaacggatgaagcgccgacagcagtaccagacgaaaacgggcagaacaaggcacatgacggtctggaaaacaatccgggaaaagacggcaaactgttttcagacaaacacccctacgttactgaagcgcatccgggagcaagaaaagccgtggacgcactgaccaggcgcatcaacgagatgatagccgaaatgccagacaacctgacgctagaggaaaaaaccgacatcgcccgcaacaatctcaagatagaaaaggcactcggcgttaccaaaggcaagcctatgacatacgaacaggcaaacaagggaaaggaaaatccgaaattcggaaaagaggaaggataccgcgtgaattgccagacctgcaccgtgacacacatgctcagaaggttagggtttgacaccgaggcaaaacccaacatcagacaaagcgcatacaatgaaatggcaaaacaaggtatcacatgggaagaacgtttcctgaaccgggacggaacaaagccggattatgactatacctataaatggcaggtcagaaagggataccaagtaatgaacgcaaaccgactgaaggaatacttcagggaaaaattcagagaggacggaatatacgagatatattgtgcctggaaaggcggctccgcacacgtgttctgcgcagaggtgactgaaggaaagacaaggttcttcgacccgcaaaccggaaaggatgatgcaagcaattacatacagagcatgaaagccaaccgtgtgggagtgataagaatagacaacaaattggtaaatcccaaaatcatgggactatttatcaccaaataaacgggaagaaagtgccagcccctcctcaccgtccaccagacggcaggactggccgtcgaacagaataaaggcgggaagaccgacaggcaactcaaaaccatccccgtcaacacagccaacggaatagatgcttccttcaggggaactggctgataaaacaacggagttataaccgtggatgtttgctaattctgacacttgttcgggtatttccataactcaaaaaggcacataaaacaccttgtttgcaaaagtataaaattattttttaaactctataatttatggacataaaagaatattcaaagctgataaatgccaaacggaaagaactggatggtctaatgaaacgaaagatgccggttatcgccggacgaatggcaaaagaccatttccaggacaacttccgccgggaaggtttcgtaaacggaggattgcacccgtggccgaaagcgaaaaggctgtcatctggaaggacggatgcggccgggaactacgggacgctgctctccgggaggaaccacctcttcagctccgtcaagtacatgccgacagactaccgggtaagagtggccaatgacctcatatacgcgcccgtccacaactggggaggagaagttcatccgactgttacgccccaaatgcggcgttttgcatgggcaaagtattaccaggcttcaggcaaggctaaaaaagccgccacgggcaaaagaaaaggcaaaaagaagggttctgccgcaaacaatgaaccacaggagaacccggaggcattaagatggaaaagactggcgctcaccaaaaagaaaaagctccggataaaaataccgcaacgccagtttatcggagaaagccgggaactgtccgacaggataacggaaaaaacagaaaacgaaatcagaaacattttaaacttataaacacatggaagaaatattcatcgcaatcatggaacgcatcgcccaaaagatgccggagctctcatacgttgacgaggattacggacagctcgaaaccggagcggaagaggaacattacccggtcaccttcccctgcgtactcatagggaatacggaatcggactggaaagacttcggatacggggtacagaaaagcatgtcgcttgtcaccgtaaggctggccgtggactgctacgacgacacgcactacacttcaggtacctatgacaaagtaagggaacggcagatgaaggcaaaggaactgtacaaggccttgcaggggttccagtgcacggaagactgcacaccgctggtcagggtcaagaaccgggattattccctgccgggaaacataaaggtgtacgaaacggcttattccttcacgctacatgacgagtcggccatgcagtaagggaaaggttcattcccccgtgaacagggaaagctggacggctgtcaggcggggtttcttaaccttcgggacaggcttcacctcaaggtccttcagttcccggcacttacggcggataatggccataatgcgttcctccgaaataaagaactcctgacgggacaacaccttcagggcgtcgtcaaagcgcagacgctgcacctccgtccagtaatagtaacggcggcacagggcttcatcacgaagttctatcaggttcttgtctcgtcctttggccataaataagagttatttactgcaaaattaggcatttggcatatcaggaaaaagaaaaacgccgcaatcacaacggatgcggcgttttttctgtttagagtgtgaacaaaatcacatggtcatcagttcggtgtcgtcctcacccggaataaaaggctcgatacgggtaatcaccttgctctgtacctttacccggccactgcccttgcagacaggacaacgggaggaggaaggggctccgctctggtctgtgtagaaaacacgccccttaccctcgcagttcttgcaagccatcacgtgtggtgcgatgttctttgtcttctccatatcacagacggcagaatgaaggttcgatacggcgccagacaccgttctcgtcacgcttgtggaaatagtagttcaccgcagtcttgtacaccacattgctctcacggaagaggtccatgatctccgtgtactcactgtcgaaacggtcctcaagctcgtacagcttgctcaccgacttgtagtccagatcaccctggcggttacgctcgatcatggtcatgccgagctggtacatagggtcatcggtgccaagttcccggctcatggcgtagcgcttcaggtaatccaccagacgctcggcggcgaggttggcacgttcgtcgaagctcttcaccttgttactcctcacttccagcttcatgtcaccgtccacgatggtaaaacttgcctggtcatccttgcggagctgcccatagtcacgcatcaggtcgcggaaagaggcggcttccttctccacccagtcgcggaaggctttcacgtcatccacgaccggaaacagtctattcttcacttcaagcatgaactgcgcacggaggccctcataggcatcgcgacggttgcgcttgttttccttctcttcctgctggagctgtttcagcagttcttttctgtcctgtgcggacaagctctttaactgttctttcaagtccataactaaaaaattaatggttattattgttccttcttgcgccgaatcgcacgcaatttcaccagcagggtatccaaaccctcacagtcaagctcccgaaactccatgccggcaatacgcctgtcacggcaataggcattgacacggtcccagttggccgtatcgactcccaaaagttgtaactggtgcaggactgcggaacgtttttgccgcaggatcttccggagctcttcccggtaagtggccggtaccaacttccgcatggcggacacggcggcactgtattccttcagcgtcatgtcacgcaggctcgtggtacgtccctccgtgtactgggaaacgatgctttccttcagtgcgtcacggtccgatgtcggaagacggttcaaaaggccgtaaaacgccgcataattttcgggtttgtttaactgtttacgggtgttgatatctatctgcatggttatatcgctcttttatttattattatgaaattactaccattgccggagcttcctgctccacctcatcaataatcatcaggtttatatcacctgtataaatatatacttccgcatccggattacaattctccaattggattatcaattctctcacagtcataattgctaccttactttttcagttttgattcattcgacaatttcatctatatcataccattctacatcagaattattcaatccatagtaagcaataagctcttcatagtcgataattccatgatattcagtttcaattggcttttccaatccaacctctttaattgttattctatagtgtttatattccatactttattatttcttcttatttttcttgatttgaattatttacttttcaatctataaatctcaattatatcctgaatatcgctcgtaggtcttactcggatattaatattttggattaataggtcgatttcgacatcagcatcttttgcaacctttactgttgttgaaatagctgttatagcgtcacctgtggcggtggctgaaaattttacatgtgtactcattactattccgatttgaattaataacactttacgcaaaataacccccttggagtattataacatccttcgcctgattcaaacaccttaccacatttcttacatcttggacgggtgtctattggtttcagtgcttcatggtagggtaagcttccggtgttgggtatgccttcaacaaatatctcttcaaggctgatacccttttctttggctttatcacctgctgctattacaatatctttccacgagttaaatgacttggttaaatctccttcatcgtagccataccaacgatcaggggctttatctatttctgtttgagtaatagagcggtaaagttctatatcatcaccagctattatttgtaacgtcccataaaaatgtatagcttcgaagctaattcctctaaatgtagttatatttacaattgctttcatgatttaacttctttcgattttgcgccacattcatcagttcatactcaaatctccactgaacggaatagtattaacgtcaacctttctcgtgtaggcctgcataagccccatggaaagcagcatataggcattcttatttgctttggcaaccccagaaatagagccgataatatgttctgtcttgccgctaaaaattgagccggctacctgttcaagaccgtccggatggtcctcactggcggcaacgctcataaagacactaagattattttctttacaaaagttatccacgtacaggcagagttcctttactgcctctttctgcttttctgtaatcattttagtaaaattttaatagttaataattatatatcgaaatcgcaaaatcctttttctcgtactgccggtacatcgtctcctcccagtccggctcctcctcttccggcaggtcgttctccccgagttctatttccttgcggtaaatcaggtaccgcgcctccaggaagaagaggaccacacggcgcaggaactcacgggcggaggcgatgccgtgcctttccatgaaggcggcgatacgctccgggccaacggtgttcgtgcggatgctcaccaaacgctgccggcggaagtccttcagcgtgctgccctttataccgagcacgctgtcagcgatacggccgaggttctccgagatatggtaaccggaaccgtcgtcatccgtccccaccagcagctcggcggcagctgtcagcataccctccacgctcatgcgctgggcagtggccgtctccttcaggaacacgtactggtaattgctcacgtaggtatgtatgagatagccttccgggcggcggaacacctctccggcagcaagttccatcgaaaggttgttcaacgtcacaccggcaccgcagcagaaggcgcacaccaggcggacggcaagacgctggcggttaccccaccccccggagacgatagcacgctgcaagctgccggcaacggccggatccatctcgaagaacagcaccgacttctcctggcgacggaaaaagaacgacatgtccggaatacggtccatgcagaggaggatacgccgggtggcagtagaaaccctgccgccgtccgtcatgcggatataggacttcaccaggtggttcatcaccaccgtcatgtcggagaaatgatagtcggccaccttcccgcggaacagttcatgaagcagaacgggcagcttcacaacgtagttgtaatattcctttctcatggctcatttatttgaaggtttccagtcaactgttataatcgcatccaactcaccgctgccgccacacaccgggcagggcacatgcacgtcctcgcggctgccctcctccgttccccagaaccagccgttacccttacagtaaccacacttgtggccggtactgacaaagttttcacggttagcccccttgcacatataggcgggaggacaaatctccagctgtttctttatcctgctcatgcctggcctcctttctgtttcggtcccgccacattccaatagtcataggcgcccttttcccagatcgtatattcaccagtggaaccctgataacgtcccttgctgaaggcgacgtatccctccacccatatcttcaggtcggcatcatacatcacgctcgtggccgcatcacctttaggattcttgccgcgggcatggctgatgaaaacaaacagcttgtccggaaactcctccttcagctggatatagtcacggtacgtcatctgggtatattggaagctgtcaatgactacgatattgaaactcttatgacgccggagcctgatcttcaaggtggggatgtcctccttgatgaacgcgaggtggcggctcacctcggccataccaaagcgccgcaggttgttctggacagtcagagaggttccctcctccagagagttgaacgccacacggtcatacttgcaaagttccttgcagagctgcatcacaaaggaagtctttccgttaccgctattcccccacacgaaccagcagccccggatctccggagtgtcgaaggcgtccttccatttcccctcgaaaggaaacacgtcatacttcttgttcagaatgtccctgacattcaaggcacgtctcatgccggtctttttattattttttttctcttcttccatggtcagaacaattttaattgccggatattgtcaattcggtcaagcacggcctgacgtgcggcaccccgcatcttctcgtggcagagcatccagccgagtgcccacaaaagggcattcccacgggtggagaactgtccccatttacgtcccggattgaaaccggcaccggaactgttcacctgcatgtgtacaccggcaacccaccagccgtcctgctgtcccacaagggcgtccaggtagtcgcgaccattccggtaaacggtcaccgtctcatattcagtcaagactggataatcgctccagggagcgggaagctgcccgcgaccgtcgatctttaagtattcaaatttgttttccatatccttaaaattacgtttgaacgacatttgaacgggggtcattcccccgtcatacgttttaccttgtgaatggacttcctcacacggcgcaaatcaaagtcacatgtcgaagcctcctttatcaccttgtcgatatctttcctgtcagtcacgccgttggcggaacagatcgcgaacacgtcgttcacgtccgtaggctccagttcgtaaaactttcgtccgatacggctgtagaactccttgtagccgggcttctggtaccgcaggccgttgctgatgcgcttggcgatgtagtcggtactcaagaacacgacaccgcatttctcctccagcttgttgtacaggctgatgaaatagtggaacaccggttcggtcagcttgtccgcctcgtcgaacaccagcaggggcgcgtccatctggatgatgtcatccaatataagcccccacacctcacggatattatacccttcggtccggattccgaccgtacgggcgatctcgcggacaaagtcacctttcttcatgtcctcggagcagaggatatagaaaacctccttatgctcctggaggtaaacacgggcggtggtactcttgccacaaccggcctcgccggtcacccaggtaacattgcgccagcgttgtgcgtcggagagcacagccgtgatctcctggtaagcaccggtctccacgatctgccagccggtagcgcttacaccaccgacctgcgaggcgacattacggaacatctcatcgctgatattctcataacggccgttcaggatattgctaacagtacctacactaacccccttcaggctgccagcagccttcgtctggctcgggtatttcgccacgtaagcccggaggctctcactgatggcgtccttttctttcattgtaatttccataatcaatattttttatcttgttataaatctgttccttataatttcccgaccaccttgcggatgctcacttccttcttctcaaagctgtcccatgtcacgttgctgatgactttcatgtctcggccgatggaaggacggggcggctggctgtattttcttgtgcgacggtcaatctggcgttgcgcctcctttccgagccctttcaagtcaggggtacgcagaccgttctgttccggtgcgacaccatgttcgtactcgatatccttggcaacgacctggcggtttatacgctcgttgatgacggcctcctgctgggcgcggatgaaacgtttctcggcttccgtctgctcctgctgggcacggtggatcatcagcgggaacgaagccacacactcgaagcgcatcgctccgcccttatccttgtacagcagacgtacgctgctcatgtcataaggatcgtactggacatagaacttcttgtaggtgttacgccggcgccattccagatcaggctcaccgggggcggagaaaacctcgtaagggtatttctttccctgtaccgtgatctcgataccgctggcggtgaacagcgacggtttctcggtcgtgtaccagaacatctccaccatatccgacacacttaccgcatcggtagcctcgttcacgctggtattgtacatctcaatccgggagatgccggtggcagggtgtttcattgaattccactgttcacgggcggcggtatactgttgcttcagctcctccagtgtgggaagggaatcgatgttcgcgttgatgaattccagattcggacggcttgtttctctctttgccgtaatgttctgcccggtgaaaccgaaacgtttcttcagcacctggctctggaagcggtagaaaatattctcgattgttttggactcaccgttatacggggctgtcggacgatggatacggctgattttcgagaaaaggcccagcgccgtgttcttcttatgaccgccctggttgtcgcaaacgatctcgtagggtttgtgcaggctcgtctggatagccatacggaaggcatggtactgcgcgatatagtcctcgttatcgctgatgtaatagccaagaagcacttcgctgtaagcgtccaccacctcatacacgcttgtagtgcacttgttcccgttctcatcacgatagtagaggttcagcttcgtaccgtcgccataccagaggctgtcacggcagcccggaaggatggtgcggtgtttgcggtcataacgctggtgcgccttcatttccccataaacggcatcgtaccacagaggttcgacacgcgggctgttgaaccattcgcggaggctgcggggactcttcaggggcttccagccacgttccggagcgacacggttgtactcctcgaagatctccatatcagtataaaccggaacgcggctgcgtttcaatgcaacaaggtaacgcccgccgtcctcctcgatcttcagcgtgttgctgttgccgtatttaccactcacaagcacaccgtagttatcaggacggaacttgtttatcaaggctttcaaccgccccacactgcccggaagactatgcccgtacaccggacgccattcctcactcgtgacaagtagaagctcccaaaggttacggcggaaaccggtcagcttgttattggatgaactcaagcgtttgaactcttccatcagcgcgttcagcaccgaagcgttccaggtgtattccttcttcacatcctcgggaagggcgaccagctcaccgttcttgtcgtaacggtaatcctcgaaaaagttctcggccttctcgtctttcttcactatgttacggatcatttcttctcgcatctgtttctcgggctcgccatgacgctcaacccaacgtttcttgtatttctcgggaagggaggaataggcatacaaagccggattattttcaccaccgccacgagaaacgacatccagtttttcccgagacaactggctgtttaatgttcctttgggcattatatccagcaactctttgtaagttacacacaatatattttcaaagtattccatctcccaacttaattatcaatcctccaaattattcaaagggacatgcttcttcagtaatcgtacggaatttccgaagttcaacacaatgaaaagttccggtagcggatgaatgaagaagacagaaagtaaagccccaaaactcatgcagaaataaagcacgcaaaggcgctgcttccggctcagaccggcgaacttgcgcagttcgtcaccgaatatatcaagcaggtcgtttttcatcacaatcaggcttttgaatgtcttcacctatctcagtaccaccacgctcaagggcgagtttacggatggaacgcgcaagtcggctgttcttgcgaaaggcaagtgcatggctaaccatcacattcgtacatcctatcagttcggcgatcttattcacctcaccgtattctaccacaattcgtcttttcatactatctaattatttaaattatcatagagagcggtcgcggactcgaaccgcggaccatgacctctcccttgcgggagtttggtgtgttctaccaactgaactaaccgcccgagaaaattataaaagttcctttatcgcattctccggaacacatattacagtccaaatctgaccgtctttcatataatcaatattatattcccgcccgaacgtacaaacgttataatcccagtcacgaactataccatcaatggtttcgccatttctcttgatgattctcacactttgtccttttttaaatcttgcttccattttgcttctttttaaattctcattgttacctcaagccttttttgtagctttggggcgtgtttaaactttaatcacgtggcaaatataaatcgtatttcgcaaattgcaaaacaatatgcgaaataatttcgcaaaatataaaacaatgaataaaaaagaaagattagaagctattataaagcattatagtgatggaaagccttctgtttttgcaaagttaataggggttgctccctcaactataagttcgtggctgtcgcgggatacacttgattacgatcttttatttgcaaaatgcgaaaacatatcatcggaatggcttttgactggtaggggagagatgattaacatacaaacttctacttttaataataaaactaccttgcctcaaaaagaaagtacaggaatagaagacaaactattagcaattatagctgataaagatgccactatccgagagatggcagaggaaatagggatgctcaaacaaacaattacacaacttaaacaggacaagtcggggcatgtttcggatgcaagcgattctacagttgccaatgccgtctaaaacacgttttatggggaaaaggaggtaaaaacagttaaatcgttattttacagcagaatatataaaaatacaggggagtaaataaatattatctatatacaatttaccccctacaatattataaaaacagataaatactaaataagaaaaagatatttccccgctttattagaacaaaatagacacaaaaatgaataaccaaatgaataaccaatcaaaacatttcgtttttgtaatagactaaatgaataaccaaatgaataagcaagtgaataacctttccactttttaaggcgttcaaagcgttcaaacggataaatacagctttccatcatagtttgacatttataaagacacaaaaaaagccgcaaaaacggcttttaatacgttctaaggctgttttaaccctttctggtagtctttatcaagtgcgattggataatcatcgcacgtttcgtgtattttacggctccatcggtcaaaccggcatgcaacaggctgcttttggtgatgccgacctgtttctccgtcagattttcaaaaatggcagagatactgccaaaatagaggtttttcttctcataaatcaggtgcacatgaataattttagtcataatatacggtatttatttcatcgcaaatataccaaatattatctatatagaataatttgaataaaataaaaaagggaagcgcgtcaagtactcccccactctacttgcataaaccgatccgtttgactatctttgtatatgagagctgatctggaaaggttcatggagaataaccggtgaacaaccccgaaatctcccctatcctaccttcaatgtaaagcaatccatttgaacggcgttcaaacgaggctaaaatgtaagcccaatgtaaagcgatgtaaacgtttcgtttttccaagtcactctcccctacttcatcataacgctttgacaaccaaagcaatcagtcattttcaggccgaccacatattgacacgtttcgtttttccccccttacaggcttttacccagatttatgaagcctacgccgaccgactttacagctttgttcttaaacaactaaaaaatcgttccctggcacaagatattgttcaggatacctttttacgcctatgggacaaccgtagccaactgaatagctttggcaacctgcaagcctttattttcactattgccaaacatcaggtaatcgattatttccgcaaacaagtcaacgaactacaattcgaagactttatggagtattgcgagaaccaagagagcgatgtatctccagaagacctattattgtatgatgaattcctgcaacaactgaagaaatcaaagaatattctgtcacaacgggaacgagagatttatgaactaagcagagaaaaacatattccagtcaaacagattgccgagcaactggagctttccgagcaaacagtaaagaactatctgacttccgctctgaagatccttcgcagcgaaataatgaaatataatattctctttattttcttcttataatatcgtcactgcaacacatcacaaggggaaggcaataatatcttctcccacaaaaaagatctctatctgatttttatgttataaaacacaaagaaatcatagtactctcttattccattcacgtataaccaatagaaacacctataatatggctacacattttaaagatttataccgccgatatatggagaagggactaccttcttctgacttgagagagttcaaaaaagaacttgaccacataccggatgaagaactttggaataccatgataaacatggaaaaagattctgcaccggaaatcgggatgccccccatgatgaaaaagcagatacgtaaggaacttcatcaaatcatctggagaagacgctggtatcaatttgcgaaatatgccgctgtcatcgctctactcgtcacctcttccttcggcatatattccttattcgatactccaagttcgcaacaaatgataactgccaatgtaaaacccggcagcaaatcagagatcatattgccggacggaacaaaagtgcaactgaatggtgccactaccatcagatatgacgtcaatgatacagaacaacgactcgtacatctatcaggagaagctttcttcgatgtagccaaaagcccggactgtcctttcagagtcatggtaaatgacttccagatcgaagtattgggaacttctttcaatgtgaatacatataagaaagatgttatcgaaacctctctgcttaccggaaaaattaaaatatccggcggctctctcccgcacgaatatacgcttactcccggtgaaaaagcaacctactccagtgtagacaaagccctcaaaattacaaaagctgatgtgcatgtagaaacaggctggtgtaatgattatctaattttcgactccgagcctttaattgatgttatagagcaaatagaacggtggtatggagtagaaatagaactaaaatatccacagattgcacaagatttactgtccggttctttccgccatgaaaatatacagaatgttatccattcattgagccttcagtataaattcaaatatgagatacataaagataaaatcattatttattaacctcaaaagaaaggagcctatgaaagatataatataagctatttaaagaaaaacaaccaaagaatcgcccaatcctttggttgtatgaaagtcgataaaattaatccattaaaacatgaaaaaatagtatcaactatgaattacacaaagttaattttttcctttaaaaagaggagacataatctccttatttttagaaactttaccattttgctcactggaatgattttactatccacaacagaagcattggcacaaaaaggaaatgtgtcggtaaacatcaataatggtacggtgaaaacattcataaaggagatcgagaaacaaacccggtatacattcgtttatcggaacaatgtcctcaacgaccaatcgaaagtgaccgtcaactgtaaaaataagcctcttgatcaagtactgtcacaagtattcactccattaaatgtttcttattcgcttaataacaataccatagtattagtgaagcaagaagtgcaacaacagaaaaaaaacgaaaagaaaaccatcaaaggtactgtgacagatggaaaaggcgaaccgattatcggagccaatgtaatacaggaaggtggcatcggaacaattacagatgttgaaggaaatttcaccgtcacagcagacctatccaagccgttggaaatatcctacatcggatacaaaaagaaatctatccgcatcggtgcttcaccaacaatcaacatagcgctggaagaagatgcacacgtcatggatgaagttatcgtcatcggatatggctccaaaaccaagcgggatgttacctcttccattggaacttataaaccgggagaagtcaatgtccgccaggtattaggtgttgacgaactgttgcagggacgcgtatccggagtgaatataacgtcagcatccggtgtaccgggaagtaaaaatcgggtcagtatccgtggaatcggttcaattaccgcaggtaacgaaccactatatgtaattgacggagtacctatcaacaatacgtcaggagatactggtgcttggggagcacaatcaatgaacggtctgaatgatttcaatccctccgacgtagaatctatacagattttgaaggatgcagcttccgctgctatttatggctcacgtgcaacaaatggtgttatcctgataacaactaaaaaaggaagcaagggacaggccaaagtaaacattgacacgaatgttagtttctccaacctgaccagaacagacaaactggatatgaccgacactgatctgtttctggaagttctgaacgaagctatcgacaactataatctgcaaaccaacagtacgcaggcacgtattgataaccctgcaccgggaaaagcacagacaaactggctcgatctggtacttcgtacggctgttacctacacgactaccgcgtctgtgtcaggcggaacagataaaacgaattattacttgtccgccaattacaaacacaacgaaggtgtaattatcaacaatcagctcaaacgttacaatttgaaggttaatctggacacggaaatcaaaaagtggctcaaggtaggaaccgccctgaatttaagttactcgcgtaataaccgcgttcccaccggctataatataggaaccagtgtcattacccgcgccatcgaacaacgtccatgggattccccttatcgtcccgacggagaatatgctgtcggaggacaggagttggccaaccataacccgatacaggctcttaacgaagaagatgtatatatcgataattaccgtgccctcggttcactctatatgctgtttaacataacgaaagacttgaacttcaaaactacactcggagaggatttcaactatacggaagaacacatttattacacagccgatcacccctatggcaataaagtaggaaagcttattgacggacgaaaatcttatgcgagtactttatgggaaaacgtgctcacttataaacactcctttgaagaagatttctctctggacgtcatgctggggcattctatacaaaaggatgtaacttcctcagccgcacaaacgggtatcggattcccctctccttcttttgacgtcaactctgttgctgccgaatactcggatataagtacaggactttcttcattcctgctccaatcattcttcggccgtttaagtctgaactacaagaaccgctatttactaacgggaaccatgcgtgctgacggttcttccaaattcatatccagcaatcgctacggatatttcccgtctgtcagcgccggttggaatttgggagaagaatcttggtggaaatatccacaaaccgatgtaaagttccgcgcaagctggggttgcaccggtaatcagggaggtatcggctcttatgcttatcaagcattagccggtggagggtacaactataacggtgagaacggtttaggactgactactgcaggcaaccgcgatcttaaatgggaaaaagcccaacaagctgacgtcggagtagacctttcttttttcagaggtgcgatcacattcacagcagatgcatttatcaaagataccaaggacttgctttaccaaaagccaactcctgctacatcgggttataccagccaggtatgtaatatcggatcaatgcgtaataaaggactcgaatttaccttaggagccaaccttagcaaaggttcattctcatggcattcagatttcaatatctcctttatcagaaataaactgactgcgcttctcgacaataatgagatattgacaaccagctcgatgcacgcccttaaagtcggcgaaccgatagggtccttctatatgattaagtggaaaggtatttaccagtcggatgatgaaattcctgccaagatttacgatcagggcgtaagagcaggagactgtatttacgaagatgtggatggtaacgatgtcatagacgaaaacgacaaacagtttgtcggctcggctaatccaaagttcaccggtggtttcaataacacattcaagtacaaaggcgttgacttgagcctgttctttacattttcgtcaggcaacaagctctatgaactgtggaccggaggtttacgaatgggtaacggtacatggccgatactgaaatcatctgcagaatcccgttggacgggaccaggcagtactaacgaaaatccgcgtgccatttatggttatacgtggaactcaaccaagtttgtcaatacccgaatgttacacgatgcatcttatatccgttgccgtacagcttctattggatataccctcccaaaaagttggattaaccggatacatatcgataatctacgcatatatttccaggcagataacctcttcatattaacgaagtggccgtatctggatccggaagtaaatgtaagcctctctgcaaccaatatgggatatgattatctctacccatcccaaccgcgtacgtttacaataggtgtcaatcttaaattctaacagatatgaagaattttattatatcgttattaacagtattattggtgtttgccactagttgcaacgaaatggaccaatatccgcataatgccgtatccagtgataacctcaccgaggaggatgctcaattactgcttaccggactctacttttatatacaaaacaaaccaacagtcaatggttatcttacacaagacattgtcggcggagatcttgtccgcggcggagcgacaggactgaaagatccggtattattggtaaaagacctggttacccctgaaagcggtttcgtcagcggaccgtgggatggattttatactgctctctaccaagtaaattcactgattgtcgcagttgacaaattagcagccagccagtcacgaaacgagatactgggagtagccagtttcttccgtggtctgatttattatcacctggttacccgctatggagaagttcccattctcgaagctcctttctcgggagacatcgcagcatctaccgaaacagaaggatggagttttgtagaaaagaattttcaggtagcaatagattatgctcctactttttccgacaagtattacgtctcaaaacaagcggcaaaggctttaatggcaagaaccaaacttgcacaaggcaaaatgactgaagctgccaaacttgctgaagaagtgataggtgatgccaatttctcacttgccgacttcgaccagatcttccgtggaaaagcaaaccgagaagaaatattctcatttgtcaatctgctcaatgaatcaagcgtaaacttgagtgcttccctctattcacgtgcttctgccaatggaggtagctatacatatgcgccgacgacaaaagtgatgaatatgttcgaaccggatgataaacgaaccgccatatcaattgatatgcaggaaacaaatgaagtcattaataaatatcccggtggagaggtgactaccgatccgatcattattacccgtttgggggaaatgtacctgatcagtgctgaagcacaaggactttccaaagggcttacccgtttgaatgagcttcggaactttcgtggtcttccttctgtacaccctgccactgaagaagacttcatagatgcaattctcaatgagagacatacggaactactggcagaaggtttccgttggttcgaccttgtccgcctcaaccgcctggaaagtgatctcggctttgagcgcaagtataacaaattacctattcctgccaaagaaaggtctctcaataaacttttaaatcaaaattcatattgggctaactaaaacaatgaaaatgatgaacttattaaaatacatgcagattctgtcatttgtattaccagtggctttcttaagttgctcaaacgatacaattgaagacgtacattataccccgcaaacaaaaatcggtcaaaaactattagcgggtagtgaaacagtggcacgtgtatataccgataccagctttgttgttgcattgggagttacggaaacagatgtccattttcaaaaggcagacagccgctctactcatatatttataatcgacattgatttgaatgaaccaggggtttcattagaagtaggtatgccgtatgatgcggatgtacgcaacaacttccagcggcagacactaacagaaatggcagattacgccgaccgtccgtggcaccgggtagctgccatgattaatgctgatttttgggatgtcagtacaatggatatcagggggcccattcatcgcaatggagtgatcttaaaaaactcattcatctttaaagaaacacttccccaacaagctttgagttttatcgcgctgacgaaagacaacaaaatggtaattgccgactctgtggagtatcgtggtatgcagtacaacctcaaagaagtgaccgggagcggagttatcgtgctacgggatggagaaatatccggcgcgacttatccaggtatcgatccgcgtacttgtcttggatattcagatgatggtcatgtctacttcatggtggctgacggacgtgtagagttctactcatacggacttacttatccggaaatgggttcaataatgaaagcattaggatgctcatgggctgtgaacctggatggtggcggttctacccaaatgcttatacgacatccgatagcggatatattccaaatacggaaccggccttctgatggacaggagcgacctgtcgtaaatacgtggatggtaacagtcaatgaaccttaaaaagcagaaagtatgaagaactcaatatttattttatctatcctattttgttgcaacttgttctgtggatgttcggaatcggacgaatccgattcccgacaatttcctccgaaactcatttccattattccgaaagctggatcgacaggaggtaccgcaattatttcaggagttcatttttctgaaacagcaattgataatgaggtatttattaacggagtacaagcggaaattatcgatgcaacccagaatcgtttagtgattgctcttcccaataatccggaaggtacttattcaatcaaagttagtgtgaaaggggaagttgtagaaggactcaaatttacttatgcaacacctcaagctccacctgaacttgctgtattacaggttatgccctcctctgcctatgcaggagatttagtgacactgatcggtcagtgtttcagcacagtggtatcagaaaatcaggtgacaatcaacggagtgactgctgaagttaaagaggcgacttccagccaactcaaaattatcattcccgacaccgaggaaggcagttaccctatccgtgtgagaattggtactaaagaagctgaaagccccctgtttacttaccttcacacagtgacattaacgacctcttctctaacccccgcacgtggaaaagccggagaggaagtggtgatttcaggagaaggatttggaacaacggtcgaagagaacatggtttccataaacggaaagcaggcaaccgtaaaagttgtaaccgcaacaacgctaaccattattgctccggagaatccttccggtacctatccagtcaaagttactgtcgcagataaaacggtagagaatctaagtttcacctacgaagatttatcttacacagttgcaacagtagcaggtaactccgcaactacctctactgacggtaagggaacggctgcctctttcaaattcccgcagggactagctctcgcacccaatggtgacatatggattgccgaaagaggaaataacgtcatcagaaaaatggatcaggaatataatgtttcaactgttgccaaaagtggcaccgttacatttaatgctccctggcaaggtggtttcgatctctcgggcatatattatgtagccaataaagctttaaataatattattaagattacacaggaaggcacttgctctgtgttctccaccgaaacaacctttaaaagtccgatgagcgtcacttttgatagtaatggtaatatgtatatcgcggaccgcgataataaggcagtaaagaaaataacatccggcggtactgtaactaactacgatatgtcttcactcaaagccggtcccaattgtatggcggtagataagaagggaagaatttttgtaggtaccggcggtacttatcagctgcatatgttcgatacggacggtacactaaaaactgtattcggaactggcgtagtacccactgccgcgacttattctgatggtgaacagaacgacctgtcaaaagcaaccatgggggcaacattcggcattgcattcggcccggatgaggtactttatatcaccgattatacaatgcataccatacgtacgctaacaccggatgcagaaggcgactatacgaaaggaacattaaaaacaatagccggtattccgggaacgaaaggtaaaattgatggttctgccctgacagctacattcaattgccctgcaagcgtactggtttcggataaagtatatatcgctgatgagcaaaaccatttgattcgtaccataacagtaaataaataaaagactatgagaaagatatacatactactgctcgcctgcccactcttatcattgtttgtagcctgcaatgataatgactacaaagcgtcagtgacagagcttaggctggtcctcgtgaaacccaccaatgtttattccggtgaaatagctacaatactgggacgtaatttcagcacggtgccggaagaaaatgctgttttcatcaacgaccaacaagcaaccgttatagaagcattcaaggacgaactgaaaataatattacctgaaatggctccgggaaaatattccatccgcgtcaaatccccctcgggtgaattgacaggcctcgagctcaattatctgaaaacacccgatcaggaatatatcgttcaaacaatcgttggacagaagggagtattcgaaatgacagacggagtcggtacggaagccacaaccaagcttcccactggtatcgcttttgctccggatggcagtttatggtttacagaacgaggatacaactatatacgacgtatctctccggacttcctggtcacttcactcctcgatgtggcagtagacggtagcagtgctatctggcaaggtggattcgattcgaaaggaaactattatttcatcgacaaaggaaaaggaatgttacggaaaatagaaaccggcagtatgtctgtttcaaccttagcatccgaaatgaagagtccaatgaatgttacattcgatgatgaagataacatatatgtatcggcacgcgacaataaggcgatttataaattcacaccttcaggtacaaaaacaactttcgccactcttaacgtatctcccaactatattgtgttcgacaaaaacaagaatatgattgttggtacttctaatgggtatgtgttgattcaaatcagtccggatggcacgcaaaagacaattgcaggagacggagtaaaaggacaagagtattatgacggagaacccggtaatccgcttagtgcaaaagtgggtgctactttcggggtagctgccggttcagatggatgcctgtatctttcggataacacgtacaactgcatccgcaaactaactcctgacgcaaatggagactactcgaaaggaacgctagaaaccatcgctggttctgggaaagcaggtttctccgacggaaaaggactgaaggctaccttcaaccaaccgtatgaaatcataattacggaggactgcaaaacaatgtatgtggcaggcgccgtcaattacctgattcgccgcattactgtcaaataatagcgagcacccggggcgatgccccgggtgacttttatcatcattaatgaattctattaagttatgacgaaaaaactttttttcttactacctattctgctaaccgcattttccatcagcgcacaaacaaggactgataaacttttgaaaaatctacatgataatgaatcgaagtatatctttgttatcgctcatagaggagactggcgcaatgcgccggaaaactccctgcaaagtatcgaaaaagcaattgcaatgaaagttgatatgatagaacttgacatacaaccgactaaagatggcaactttatttgtatgcacgacgaaactctcgaccgtacttctacgggaaagggaccgataaaagattatacgaccgaggaactgaaaaagttcgtcctacgcagcggcaacggaatcaaaacccgccaaccaatccccacactgaaagaagcattaaatgtctgtaaaggccgtattcttgtcaatatagacaaaggaggtacttacataaaagaaattatgcctatcatccaggaatgtggaatggagaaacaggtcatcatcaaaggatactatcctgtagagaaagtgaaaaaagagtatggctccaatgaaagcatgctttatatgcctatcgttaatttatgggataaagaagcagttgccactatacaaacttttatcaaaaactttaccccaattgcttacgaactatgcttcaaagatgatgcaaatccgaatctaaaaataatagatgaaatcgctaaatcaggtagtcgggtatggatgaatactttatgggatagtctatgtggcggacatgatgatgagaatgctctattggaaagtaaagataaacattggggttggatgttaaagcataaagcaacaatgatacaaacagaccgtccacaagaacttattcattatttggaggaaaaaggattgagagatttggaatgatcttctctataagtcattcgaaacatcttattaaagaagtagtgggcttcttgttttcaggaacaacttaacacatttgcaaaagaaaaaaggtcagttcacccccatgaattgacctttatttcttcttatttctttccgttattcgtctctaaacttaattttcagaatcttgctgatagcaggtttatacttctttagcatccggtcgaatcccaaatcgttcggatgagttccgtcgatggttccctcgtgatctgttcccaagaaacggtcttctttaatgaaatacaggttctttacgccttttttacgcagtacttctacttgctcggcgatagcctcattctgttgctttacattctcacgggctttctgattaaagtttcccgtttcgcgtatcaatgtctgtatgataataataggtgtatccggatgtttctcccgcaaggtcattacaaagcctacagcccgttcggtaatctcttttggagaaggattgggaatacaatccaagataaaagcgtctgcatcaatattcgctaacatcccggcaacttctttctccatttttccattaccactcaatcccaaattaatgaaattatatccactgctacgggataagcgggccggataggccatgcccggacggctggcagaagctccctgcaaaatactggatccgtagactactattttctctttgaacggattttctcctttatgtatgtgagcatcagaagaaacgcctatctccagactcttcaactcatcgtataagggcagatataacaaacattctttctcttcggttcccatattatcgacaatcactctttctgtagtcacgccacccggcatccctactccggcaaattgccatttcccatcccgtttgatatacaaatccaagcctttctgggctagtctggtcaagtttggcaattggtaattgtcaggaacagtccatttagcttttatcaccgggctgttcgttgtgaaggaaatagccaaacccgcagagttggtgaatagcttctttactgcaggaggcatcgtacaatactttgctgtatctacccgatggaaatattcaccttcggtagtcgcttttcctaccaataaaagctcctgggccggcacataggtaaaattgctcttctgctgtccgaatgttgtaaggggaaacattatcagccccaggcaaatccaaacatttcgtgttaagtttctcatggttagtttaatattaacagtttattaattgtcagtatatcgtagcagtatcaaaaagctacttataaatcagcgttgataaatactcttctgcaaacatttcattggcaacctccagtagttgctctgctgttaactcttcaatacgcttaaaaacaagctcggatgattcatatttatgataatgaaggtatgttttcgccattcccagtgcattattctcaaagttatcagatgccactccgatttgtccgatcaactgctttttcgctgctgccaattgggaggaagtcatttttacatcacgcatccgcttcagttccttataggtcagtttcaaacaggtgtccatatcatctacatccgtcccgaaataaatacagaaagcccctgtatccgtgtaagaggtcagattggattcgacgttataaaccagccctctacgctcacgaagggacacattgagtttgctattcatcccgggacctccgaggacattgttcaataaatagagagccgtacgtttgtcgtcatacgcattatagccacggctaccaatcattacatgtgcctgatgtgtgtctctgggaaccgtcaaatgttccggcacataaagaggcggaggtgtacgacgattctctactcttacatcaggaatatccaggaggtatttctctaccaggcggatgattcttctgaaatcatattgtccctgaacaaaaaacaccatatttcccggttggtaaaaccggcgggtaaacgatagaacatcctccgtgcgaaaactccgcagaagttccggtttaccaagaatgtttcttcccaatggatgattgcggaagatcatatcttcaaaatcatcgaagatcagttccgacggagtatcctcatacgactggatttcatcaataatgacctccgtttctttttctatctcatgctgcggaaaggttgaatgaaatacaatatcccccaacagttcaagcgcccgttccagatgttctttcaggaaagcggcatagaccaccgtttcttccttattagtgtaagcattcaggtcgccccccacattctccatccggttgaggatatgccaggctttacgcttctccgttcctttaaaaatcaggtgttctacaaaatgggccattccctgctcattctctgcctcatcgcgcgttccggcatcgatcgcaaaaccacaataagctacttttgagagggtcggttcatggataatacgtaagccatttggcaatgtatattcgttaccttgcattgttttatacttccttattgaattaatgccacaaaaatacaataaaacttattgctgtttatagaaaattgcagatatttgtggactataacagcaacaacgtatatggaaaagataggaatattctgttccgcctccgaaaacattgacaaaatgtacttcgaaagtgcccgccaaataggagaatggatggggcagaaaggcaaaaccttgatatatggaggggccagcctcggactgatggaatgtgtagcccgcgccgtgaaagaaaacggaggcaaggtcatcggagttgttcccgccaaactggaggagaacggcaaagtaagcattctgttagacgaagaaattcatacccgcaatttgagtgaccgcaaagacatcataacggagaagtcggaggtgttagtcgcactacccggaggcgtcggtacactcgatgagattttccatgtaatagctgctgcctctatcggttatcaccggaaaaaggtcatcttctacaatgaatatggtttctatgacgaactattgaaagcactccacaccttggaggataaaggttttgcacggcaaccattctcaacctactacgaagtagcaaacacattgaacgaattaaaagaaaaaataaactgattatatgatagactccatcaaacaacttttgcaacaggaagcacaagctgtgctcaacatccctgtaacagacgcttatgaaaaagcagtgaaactgattgtagaacaaatacatcagaaaaagggaaaactggtaacttccggtatgggaaaagccggacagattgccatgaacattgctacaactttttgttccaccggtattccatctgtctttctgcaccccagcgaagcacaacacggggatttgggtattttacaaaagaatgatttactcctgttgatctccaactcgggcaagacacgggagattgtggaattaacccgtctggctcataatctggatccggatttgaagtttattgttattaccggcaacccggacagtccgttggcaaaagagtcggatgtttgtcttagtaccggtaagccggctgaagtctgtgtgttaggcatgactcctactacctctaccactgccatgacagtgatcggagatatattggtggtacaaaccatgaaagaaaccggatttacgatcgccgaatattcaaaacgccatcatggtggttatctgggagaaaaatcaagatcactatgcgaaaagtaatcggtatcggagagacaatcctcgatatcatctttcgaggtgaccagccttccgcagctgtaccgggaggctctgtattcaacggcatcgtctcattgggacgaatgggaataaacgtcggcttcatcagtgaaaccgggaatgaccgtgtaggcaatattatcctacagtttatgcgtgagaataatatccccacggatcatgtcaacgtattcccggacggtaaatcacccgtatcactcgcttttctcaacgagcaaagcgatgctgaatatatattttacaaggattatcccaaacaacgcttggacgtcccattccctaaattagaggaagatgacattgtgatggtgagttcgtattatgcattgaatccggtactgcgggaaaaggttctcgaattactcgatcaggcacgggaaaagaaagccatcatctattacgacccgaatttccgctcttctcataagaatgaagccatgaaactggctccaaccattattgaaaatcttgaatatgcagatattgtacgcggttcattagaggatttcctctatatgtacaacatgcaggatatagacaagatatacaaggataaaatcaagttctattgcccacaattcatctgtactgcaggcgggcaaaaggtagcattgcgcaccaatctggtcaacaaagattatccggtagcaccgttacaggcagtcagcaccatcggagccggcgacaattttaatgcaggactcatttatggattactcaaatatgatgttcgataccgcgatctaaataacttgaatgaagaaatatgggataaaataatccaatgcggaaaagacttcgcagcggaggtttgcggaagttttagtaattcggtatccgtggagtttgcaaagaaatacaggtaaaactacagattaagatttataagccagcagcctatcctacaaagactttatattatataatccatattaagctaatcagtaagccttaacttaatatggattttcttatctttgcaaacaccacaattaatacgcaatcttacttaatacacatgaaaagatttattctgcctctattaataataatccttattcttaccagtttgccaacaaaagcaaataatgagatcgaatcattattaaaaacattagataaatctctacaaaacaaatctgtctatactaaacaaaaacagaggcagatagacagtttaaaaatagcattaaggcaatccgacaatattcaagaaaaaataggaattgcccagtccctttgttttgaatattcatcttttcagaaagattcggctttagtttatgccatccatatgaataaccttgctcaaaaaagtaatgacaaagaactactaattgaggcgaaattagattattcaagaatactatcttctatgggctttttcaaagaagccttagcgattgtcaactcaacacaacaagagcaattatctccgcggctgaaagctgaatattttctcggacaagtcacaatttataatcatcagaaaacttttgcctcaaatgagaatgatgcacaagagaacgatctgattgcacaaatttatcgcgattcacttcttcaatgcaaggaagtcccctcaaacgtacgagcattcatgtcagcaccgactcttctcttccataaaaaatacgataatgctattcacatattagacagcgtttacaaaagttatgcaccttattcacgagatgccggaataattgcatattctttagcttctgcctatcaaggcaaaaatgactctgaaaatatgattaaatatttcgcgatatccgctatctccgacgtattaaatggagccagagagaatttctctctaaaaattctcgccaaattgatctttgaaagcggagacatagaccgggcatataaatatatgaaaaatgcaatggaggatgctatcttatgtaatgcgagaatcaatactattgaagcttcagacatgtacctttttatagataaggcatttcaggaaaaggaaaaaaataaatttatcaccataaccatattgcttgtagcattgtgttttgtctgtatcttattgtgtgctttgttcatacaactaaaaaaacaaaaaagaaaagtggagcaagccaatgaaagtttatcctatcatctttacgagatacaacaaatgaactcaatattagcagataataataaaatcaaagaagaatatgtaggactatatatggaacaacataccagttatattaacaaaatagccaatttaaaaaagagggcgcttaaaatagccaaaagcgaagatattaaaaaagtgacgtcattccttcactcttcactcaacacagaagaagatctggctgaattttataataactttgataaagcaattctaaatctttttcctaatttcgttgaggattttaatgcattgctcttaccagaaaatgtaattattccaggtccgggtaaacttttaacgcctgaattacgtatcttcgcactaatccgcctgggaattacagatagcgtaaaaatagcccacttcctgcaatattcattgtcgactatctataattaccgttcaaaaatgcgaatcaaagcaaatggagatcggaatgaatttgaagaaaaagtggctcgaatcgggcaataaattcaagaataatagtctatcagccaccaatagcatttacatttatgtaatatccatcaatacgtatacacctaattatcaaacaagtacatcctacaagcatttacaattcgcttactacccattttataagtagtcggaataaggtatttttgtagagtcacagtagcagtgatacctgggacttgatctccaatgattaatcccccaataaattgaaaaacaaaattggactattttataaatatcaattaatgaaaggaaactatgaatagcctattgctcaatgttatttgtgctttcgccattgcgaacacaagtcctaacgcagaaagagcccaacaaactttggacgccctttacaaaaactatgcagcacctaatacttgtttgctgcgcgaaaattatccttctgaccagaacaacaaagcaacttatctggcgtcagaagaacaagcaaaaagacataatgaatattcttatctttggccgtactcgggtacattctctgcagtaaacgcactgttggagagcactggaaacaaaaaatacaagaaacttctggaaaataaagtactacccggattggaagaatacttcgacacacgaagagaaccattcgcttactcatcctatatcagtaatcaacctctctctgatcgcttttatgatgacaacgtttggttaggcattgattttaccgattcttatcgtatgactaaaaaacaagcctatctggaaaaagccgaactgatatgggagttcattcttagcggtaaagacgaagtgctcggaggaggaatctactggtgtgagcagaaaaaagagtccaaaaacacttgttcaaatgcaccgggagccgtttttgctctcaagctatttcaggcaactcaagacagcacctatttgaaacaagggaaagagttatacgaatggactaaaaagaatttagaagatccaacagatcatttatactttgacaacattgcactcaataagaaaatcgggcgtgccaaatttgcctataatagcggccaaatgatgcaagcagccgccctactctaccaaataacaaaacagaaaaactatctggaagatgctcaaaatatagccgaagcatgtcacaagcactttttcactcatttcacctcgccgaacggacaaacatttcaattactgaaaaaaggaaatatctggttcacagcagtcatgctaagaggatttatagagctttatcacacagatcacaataagacctatctagccgacttccaaaaaagccttgattatgcatggcaatatgccagggataaacggggactcttccaaacagattggagcggaacagataaaaatgagaaaaaatggcttttgacacaagcagcttttgtagaaatgtacggcagattagccggaatcaacttataataaccacttttaataatcctctcaaaaacactgtaaagatgaagaaaagaaacatcggaatatgcattattacaaccaccctattaatgggaagtcatgcgaatgctactgaacttattcttgctaaagatcataccaatgtagtcaatcaggcagctgaagtggccgcttataaaagtaaccgtccacctgtaaacaagcgtctttttacatcaaaagctgtggaagcagaaattatcagagtaaaaaagttgcttactaaccaaaaattggcgtggatgttcgagaattgttttcccaatacccttgaaacaacggttcattatcgcacaacagacggcaagcctgatacttttgtttatacaggcgatattcatgccatgtggctacgtgactcgggagcacaggtttggccttatgtacaactggccaataaagacccggaattaaagaaaatgcttgaaggagtgatccgcagacaatttaaatgtatcaatattgatccatacgctaatgcttttaatgacggagctgtcggaggggaatggatgtccgacctgaccgacatgaaacctgaattacatgaaagaaaatgggaaatagattctctatgttatccactacgtctggcctaccaatattggaaggaaaccggtgatgccagtatttttgatagtgaatggatacaagccatcaccaatatcctgactacttttaaggagcaacaacgcaaagaaggagtgggaccttataaatttcaacgcaaaacagaacgtgcactcgatacattaaacaataatggcctaggtgctccggtaaatcctgtcggacttattgtttcagctttccgcccatctgacgatgctacaaccctgcaatttctcgtgccgtctaacttcttcgctgtttcttcgctaaagaaagctgccgaaattctaaatgctgtaaatcaaaatgcagaactggcaaaacaatgcacagatctggcaaaagaagtagaagctgcactaaaaaaatatgcgacttataatcaccctaaatatggtacaatttatgcctttgaggtagatggcttcggaaatcatttcttaatggatgatgctaatgtaccaagtctgctggcaatgccttatcttggtgatgtagaaatcaacgatcctatctatcaaaatacacgccgttttgtatggagcaaggataacccctatttcttcaaaggaaaggcaggagaaggtattggcgggcctcacatcggttatgatatggtatggccgatgagcatcatgatgaaagcatttaccagtcaggacgatcaggagatcaaagattgtgtaaagatgctgctcaatacggatgcagggacaggctttatgcatgaatctttccacaaagatgaccccaataacttcacccgtgcttggtttgcatggcaaaataccttatttggcgaacttattctaaagttaatcaatgaaggaaaaacggatttattaaacagtatccaataaagctgattcaagcaacttctcattcagggcgctcttccaccggaagatgcgcccttttttaacacgtaaattactattaactttggctaattatcgcaaaggaattatcacatcttcgggtaattcttatctttgcagtatacgattcaagacaaagaaactatgtataaaaacctgttaagctggcttactgttttattagtgctcccgtcgtgctccggcacatcacctgctatatctgtggtgtgtgaggaaaataatataggaaactgtattatcaaatgggaaacaacaccgatattaaaaggacaggtaaaagtatacacctctacttctccggaaattattccggaagattctcccattgcaatggctagcatctccagtggtaaaatgacaatcgtaaccaacgatccgtcccaacgttattactacttgatggtgtttaacaacaaataccatatcaaagtagctacccgcaacatcaatatccccggtatacagaacttccgcgacttaggaggatacgaatctgccaacaccggaaaatctcttcgttggggaatgatataccgttccgcacaaatagacagtatccctccttgttcccgccaagagcttaagaatatgggaatacgaacaatcatagacttacgtcctgaaagtgaacgccacaactatccgcaactacatgatgacaagtttaaaatcgtacatatccccatcctcacagggaacatggaaaaaattctgcaaggtattcgggaagaaaaaataaaaactgataccatctaccgcctcgtagaacgaatgaaccgggaactggttacaaactaccaaaaggaattcaaagagctgttcaccgttcttctcgaccgtagcaattatccggttgttattcattgcacatccggaaaaggacgtacaggagttgttcccgcactcctactcgccgctctaggcgtcaatgaagatgtgataatggaagattatcgtttgagtaacgactatttcaatatccccaaagcctctaaatacgcctataaattgccgatcaactctcaagaagcaatcactaccatctattcggccaaagaagatttcctgaatgccgcaaaggaacagattgaagctgaatatgggagtgtacaaacctatctgaaaaaaggaatcggactttctacggaagatttaaaacagttgcgcagcattttattaacagataattgattgttgataaatgataaatacgatgacgtctacaataattatccgttatcaaccatttattatcaactaaattaactatctttgcagccgaaataaaagatatacagagatttaatgaagacatttgaagagcttggcgtttctccggagatacgtagagcaattgaagaaatgggatacgagaatcccatgccggtacaagaggaagtgattccgtaccttttaggagaaaataatgatgtagtagctcttgcacagacaggaacaggtaaaacagccgcattcggtttgcccttgctccaacagattgacgtaaaaaacagaattccacaatcgcttatcctctgccctacccgcgagctttgtctccagatagcaggagatctaaacgactattccaaatacattgacggactgaaagtgctgcctgtatatggtggttcttccattgatagccaaatacgcagcctgaaacgaggtgtacatatcatcgttgccacaccgggacgtctgctggacttgatggagcgcaaaaccgtatctttatctaccatccacaacgttgtaatggatgaagcggacgaaatgcttaatatgggattcacagagagtatcaatgccatcctggctgatgtgccgcaggaacgtaacactctactgttttctgcaacaatgagcccggaaatcgcacgtatctccaagaactacttacgtaacgcgaaagaaataactattggccgtaagaatgaaagtaccaacaacgttaaacacgttgtttataccgtacaggctaaagataaatatgaagctttaaaacgtatcgtcgattactacccacaaatatacggtatcattttctgccgtacccgtaaagagactcaagaaattgcagacaaattgatgcaggaaggttacaatgccgattctttacatggcgaactttcccaagcacaacgggatgccgttatgcagaaattccgcatccgtaatctgcaactgctcgttgcaactgacgtggctgcccgtggacttgacgtagacgatctgacacatgtcatcaattacggattgcctgacgacacagaaagctatacacatcgtagcggacgtacagggcgtgccggaaaaaccggaacttccattgccatcatcaacctccgcgaaaagggaaagatgagagaaatcgaacggattatcagcaaaaaatttattgtcggagaaatgccgacagcggcaggtatctgtcaaaaacagctgattaaggtaattgatgatctcgaaaaagtaaaagtgaacgaagaagagattgccgactttatgccggaaatctatcgcaaactggaatggctaagcaaagaggacttgattaaacgaatggtttctcacgaattcaaccgttttgcagaatattaccgcaaccgtcctgaaatagagcaaccaaccgatatgcgtgcagaacgcgccggacgtggtgatcgtaaagaaggaggtttcgagaaaagaagccgaaaagctgctccaggcttcaaccgcttatttatcaatctgggtaaaacggacagcttctttccaagtgatcttatcggactgttgaacagcaatacaagagggcgcattgaattgggacgcattgacctgatgcagaactattctttctttgaagtacccgaaaaggaagcgaccaatgtaattaaagcgctgaacaaagctaaatggaacggacgtaaggtcgttattgaaatagccggtgaagaaagcggaaaaggacgcgaaagcagttctaatgagcgtaagggaggtaaacgattcggcggcaaaagtgacgaacgtgcaccacgctatgagaataaggatagaaaatcgaaagatgcttctgcaaaaggtgctaaatcagctaaaaaagataaacctagtcgtgcagaacgaggttattctgatgcccgtggtccaaaaaagaaagatgactggcaagaatttttcaaagacaaagagcctgacttcagcgaggaaggatgggcacgtagaaaacccaaaaagtaaaaaggaattcatttaaataaaatagaaaggcaactaactaccacagattagttgcctttctatttagtaaatatatatcttttatcgaaacatttacttcatcgagctatcttcaactcctgaacaagattgcccgccttaccatatttctccataataaagagcatataccgcacatctactccgatgcaacgctgcaagtcaggttcaaatacgatgtcactgctcattgcttcccagttgccatcgaaagccagcccaagcaattctcctttggcattgaacatggcactaccggaattacctcctgtaatatcattattagaaataaagcaaacattcatgtctccctgtgcattggcatatcttccgaaatcaccggaagaaagcaaactcaacaactcgggctggacggcaaagtcaatatcacctgcatgttccttcaccttctcaaagatgcctttcacagtggtataataatcgtaagtggccccatcaaaaggagtataccccccaaccgttccgaaactaagccgcatagtggaattggcatccggatagaaattacgatcggcatacatacggcgcatggcagcgttgaacaagcgttccccctgctctatctgctcggaagcttcggaaatactctgattcatctcataatacttcacgatcaggtccagactcaaggaaacagccgggtcctctatcagattatacgtagtatcccgctccagaaaacgttttaggcccttaggagacgttatattggacgttgcatacaaagagtctacataagcctgaatattcccgttatagagtgtatctatcttttcatacatagcaggcagatacttcttatccactttcaactgatactctttgagcatggcagcaaaaacctccttatcaatggaaagatcaagattatcatacttctccaataacttcttcatgcgggtaatcaccagcttctcctcggcctcaaagtcgaaattgagaatttcaagagcaagctgcaccaattcgggaccattgataaacgattcaccgaaataagccaacgcacgatttgtttcccgacgattactataactcaactccagagaagagaataaacgaatcagtttctctctttcttccggatgagactgaatccagtcgcgaagtgctgcttcagccgcccgtttcttttccaataccttcagatgcttgatggccttgtttgttccgatgctattcttccaataattggaactttcatcgtattttgaagcatacttgatacgaatatccggacgacgatccatctcccgtttccaaaccgtttgttttactccccgcacatcaatcattgcctggttgattccattcatcatctcttcgataccatacgaagaaagataacgttccgtacttcccggataaccaagcgtcatgcagaaagaaccttccttgtatccatccaaagagataggcgccacatattcagggtgataagggacgttgtcaggagaataatcagccggaccattcttggtgtttgcatagatacgaaatacgctgaaatcgcccgtatgtcgcggccacatccaattgtccgtatcccatccgaacttcccgacagaagaaggaggtgcaaagactaaacgaacatcgttataatcacgataaacggaaagccagaattcattacctgcataataagcatcgacaataccggtcagcgtagaatctttttcggaaacttccataccgattacattcatgatcgaatcgacagctacacggcgttctgtttccgttttagcatagcgggcagcagataatacccgtttggttacgtcttccgtacgaagcagaaaacggacatacaactccggattcggcagctcttcgtcaaggctacgtgcaaaaaagccatctttcagataatcatgttctacagaagagtgttgctggatactgctgaaaccacaatgatgattggtaaacaccagaccgtcttcggaaaccaccactcccgaacagaaacctccaaagctgacaacagcatctgaaagagagggtttcttcggattatatattttattcacaggcatttgcaaaccaagttctttcattacccggtctgtctgtttgtttttgcgtaggtttcccagcagccacattccctcatcggcaaatacatttgacagacagagggaaaagactatcaagacggttagtctgaatttcatattactatttttagattcattattcggtaatcagcctcaacttcttcgctcctacacgggctttcagccattcgctgattttctgtttctcggcagcagacggatgtctgtcgaatttcaaaacagccaatgttaccgtatcggtcttcatcgagtcaacccgcacttcgagcgaatgagcgatggagagcgtagtgatggaagggtaaagcactttcagttcgggcactaatgtacgactcattgcatcatacgttctgtattgttccaatgttgtctccagttgggaaatcttcactgcctgttgctgaagtcgctgctcgctgtttttgtagaagtcttccatgaccatggcacggatagaagtcacatctaccgcttcattgttcatcccctgcaatacaaccagcttcgtatcttccaacttatattctttcatcttgctacgggcaatagaaatcgaagcatcaggcacttcaggaccaatcaaaacaacccgcacttctttatgttcataactgatctttttatcgagtacctgtgtattctcaaagcttaactgatcgctaataaaacgattggctgccgcctcatagaaagtgctttttataattccaaatgtcagataaaccgcagggcacatggtaagcaccacaatcagaacgatgtatttacgtacggtcttctcacgggttttatctacaaattccttccgctggaaatgcatcacacgaactccgaggaaagtggccagactgataaaaacagagttgatgaagtaaagataaaaagcacccaggaaataaataagattaccggaggccagtccgtaacctgccgtacaaagcggtggcatcaatgcagtagcaatggcaacgcccggaatcacatttcccttttccttggtagagagggctaccacacctgccaaaccaccaaaaagcgcgatgaatacatcataaatagtgggcgatgtacgtgccagcaactccgactgtgaaccggcaataggggcaagaaggaagaagatagtggccgtcgtcacactgaaagcggtcgttatgagaaagctctttaaagagcgtttcattaattcgaagtcgttcagtccgacagagagtcccactcccataataggtcccatcaacggagaaatcaacatggcaccgataattacagcagtagaatttacattcaatccgagtgatgccataaagatggcaaaaatcaggatccacaaattggcacctttgaactctacacccttacggatagaatccacggtggccagttcgttatccttgtcttttttcaagtccagatattctcctagaaaggacttgatagcaaacttattacgttcatctgtcttcatagttatttcttctttataaagcgattaataacaggaatctgactcaatggtaaatccttcttgataatataagctataaatagcaataagagtacggtacggaaagcgagacggagcaccagattagggataggcacctgttctccaataacgtaaagcaccgctgccagcagaacataaagtccgaggcttttcaaatcataacgaatcgggtattctttctgccctatccagtaggataacagcaagattaccgcatagcctgcaacagaagcccatgccgaagcaagatagccgtaaaccggcacaaataatatgttcaatacaacaataatgacacagccgatcaccgagaagtaagctccccaataggtcttatccgtcagtttataccaaaaggaaagattgaaataaatccctttacagatttctgcaagcatcacaatagctaccactccaagaccttcccagtaaccttttgctacaagataacgcagcaaatcgaggtagaacattacagcaaggaaagccaacaatgagaagataagaaaatatttcatcgcagccgcatacattttccggttatctccttcgcggtctttgccaaatacaaacggttcgtaagcgtaacggaaagcttgcgtaaacatggccatcaccatcgcaatcttgctggttgccgcataaatacccagttgtactaacccttcctgtcgatcttcaaagagaaacggatagatcatcttgtcaacagtctgattcagaatacctaccaaacctaagattaataccggaaaagagtatactaccattcgcttcagcaacacccggtccaacttataagcaaaacctgtcagctctggaataaagaagaacatctggacaaccgagataatcaggttgctaatgaaaatatatcccaccagatagtccggatcataaaaccaagagatggttgccggacaatgtacattcagccacggacacaccaacaggaaaaacagattcaaaccgatgccgccaatgatagagagcagtttgatagctgcaaacttgacagggcgtttcttgtatcgcaaataggcaaaaggaatgcattgaaaagaatctaaagctaccacaacagccatcatcgctataaattccggatgatcgccataatccagcaaattggaaataggttgcaggaataacaggcaaaggagaacgaaaatcaaagatacgcctcctactgacaatagggagttggcatatactttcatcgggtcttctcccgatttattggcgaaacggaagaatcccgtttccataccgaacgtaagcagtacgagcatcagggctgtaaacgcatacacgttcgatacgactccgtaacctccggtggaagccggtaatacagctgtatacagaggtaccagcatgtagttaaggaatcgtccgacaatactacttaacccataaattgcagtatctttagctaatgattttagtccagccatgttttattagtgattatcattcagattggttcaacgtttcttcttttgtttgaacaaccaatccataaatccgggataattgaaagccggattccagcttccatgattacaaccgggaaattcaatatattccacatctgcaccggcagctttcagtgctttatatgcttcgcgagaacctttcaccggaactacatcatccgcatctccatgaaagatacggaacttcacatctttggcagccgacaaccggcttggactgactataccgcagataggaattgcagcagcaaatatctccgggtagcgtattactaaatcatacgttcccatcgctcccattgaaaggccgataatataaacccgttgcgtgtccacttcgggcatcaccagataggaatcaagcaactgtttgagtgtctgcaatataggactgatctcctgtcctaccggcatttcagcaggtataaaagacttcggacgttccgtataagcccagtaaccgtctgtcggacactgcggaatcagcacaaaagcaggatacttttcttgattgaccggattaagaaacatctgtccgccatgagtcaattgcttctcattatcatttccccgttcgccggctccatgcaaaaacagcacgatggggtacttctcacccggtttcaccgattcggggtgaatcatccggtaaggtaaggaatctcctttagaagaaacaaaaatatctcttccatatccctgttgagccgatagagaaaggctcaaaaagagaaaaacaaataaagtagtccattgcttcatcatccaactatgctttataaagttcttttataccgttaataccacttatcacatgacgctttatgtcagtcattaaacagtgttttctgactgttataaagacttcttcccaaatgcttataggcaagttcggttacctcgcgtccgcggggagtacgtttcatgaatccttcttttatcaggaaaggttcgtaaacttcctcgatggttcccgcatcttctcccaaagccgtagcaatggtcgttataccgacagggccgcctttaaacttgtctataatggtacaaagtatcttgttgtctatctcatccagtccgtacttgtcgatattcaatgcctccagcgcaaactgggcaatctccgtatcgatagagccggtgcctttcacctgtgcgaagtcacgtacccggcgaagcaaagcattggcaatacggggtgtcccacgactgcgggaagcaatctccgaggctgcacgtaccgagcaaggcacatccagtatggacgcagaacgacggatgatattgctcaaaatatcatcgtcataatactccaaatgaaggttaataccgaaacgtgcacgaagcggagccgtcagcagaccgctacgcgtggttgcaccaaccaacgtgaaaggattcaaatcgatctggatactgcgtgccgaaggtcccttatcaatcataatatcgatgcggtaatcttccatggccgaataaagatattcttccactacgggcgacagacgatgaatttcatcaataaaaagcacgtcgttcggttcgaggctggtcaatacacctgccaggtcacccggtttatctagcaccggaccggaagttactttaaagccgactcccaattcgttggcgataatatttgaaagagttgtttttcctaatccgggaggaccatgcaatagcacatggtcaagtgcttcgccgcgcagacgtgccgccttcacaaaaatgcgaaggttttccaccaccttgtcctggccgctaaagtcttcaaaacttaacggacggagtgcattctcgaaatcccgttcttttgaagtaagctgatgttcgcgtatgttaaaatcttcctgttccatttatttcttgaaaagtaggagacaaagatagagatttacattcattttcagtataagaaagacgaagatttagtttatttgaaacgtaataactacttttgcactatctatatacacgctatcaactatggttctaaattacatttggataggattctttgtcgtcgcctttatcatcgcccttgtaaaagtgatttttctgggagatacggagatatttacagctatcatgaacgctacattcgattcttcaaagacagctttcgagatatctctgggacttacaggcgtactggctctttggttgggtatcatgaaaatcggagaaaacagtggattgattaacgcactggctcgctttcttagtccggtgctttgccgactatttccggatattcctaaagaacatccggtgttagggtccatcttcatgaatatgtctgccaatatgcttggtctcgacaatgcagccaccccattggggctgaaagcgatgaaagagctgcaggaactgaatccgaaaaaagacactgcttccaatccgatgattatgtttttggtgattaatacctccggccttatcatcattccgatcagtatcatggtatatcgtgcacaaatgggggctgcacagcctacagatgtatttatccctatcctgctaagtactttcatttcaactctagtaggagtcatagcagtcagcatcgctcaaaagataaacttaatcaataagcctattctcattttaatgggcgttatctgccttttcttttccggcttgatttatctgtttctaagtgtctcgcgggaagatatgggtacttattctacattgatagcgaatattctgctgttcagtgtcatcattctgtttattttgacgggagtcagaaagaaaatcaatgtatacgattcgtttgtggagggagctaaagaagggtttacgacggctgtacgcatcattccttatctggttgctttccttgtaggaattgcagtgttccgcacttcgggagcaatggattttctggtgggaggcatcggctatatagtaggcttatgcggagtggacacgagctttgtaggagcgctgcctaccgcattgatgaaatcgcttagcggtagcggtgcaaacggattgatgatcgatacgatgaaagaactgggacctgattcgtttgtaggacgtatgagttgtgtagttcgcggagcttcggacaccacattctacattctggccgtttatttcggcagtgtggggatcaccaagactcgtaatgcggtgacttgcggtctgatagcagacttctcgggtatcatagccgctatcttaatcagttatttatttttcttttaaatcataacattcaattatggctgtaacttatcaaacagaaggcgtaaaaatgcctgatatcaagaaacgtgagactacggaatggataaaggccgtagctgcttcttacgggaaaagactcggtgaaatcgcttatatcttctgctcggacgaaaaaattctggaagtaaaccgtcagtatctgcaacatgattactacacggatattattactttcgattattgtgaaggcgatcgtttatcaggtgacttattcatcagtctagatacaatacatacgaatgcggagcagtttggcacctcatacgaagacgaactacatcgtgtgattatccacggaattcttcacttgtgcggcatcaacgataaaggtcccggggagcgggagattatggaaggtgctgaaaacaaagcattatctatacgaaaagtgtaaacaagcctcaacagcaaacgatttcaataaacaaacgatttattcaaacatactatactgtataaatactgtaaaacgaagacgcctcatcgtaatcactacgacgaggcgttttcattagcaacgtaatgctaatttaaacactaaattatttaagagagagatttattacttcttatcaggggttacttctggagtaaccaatttcttgattgatttcatattcagatacagaaaggccaaccgcggctgtgcttcctgaacaaccaattccaatgaatctgatgttacataaccaatacgttcacgtgttttatacacttctacttttccgttatcttctttactaaatccttctataatcaaatagccgttgtcgatcttccatgttctaagatctaaagacggtacattgatagcagaacatttaccgccttttttaaactcaaaccctttgagttcccctgtagattcataggtataaggattacaccatttaccaataatttgtttctccactttctgtccatagctgctgaatgcaaagcaagacagaaccataactgtcattaatagtttcttcattttaatttatttttctagtaaatcatatttctgatcaattccacgttctcgcaaatgaataccctctttcatccaacgcggctcttttgttcctttcaggtaataatcaaagaactgtttcatccggatagtccagtctttctgtgcagcctgattaccaagaaaatgcccttcgcctttgtaattaagatgccatgccggacgttgtaaacgacgcatagctaaataaagtgcacgaccttgttcgtaggcaacagcctcatccttatcattatgccaaattaataatggagtatgtattttatccgcttccacgatagcagagcttgccaaatacttatctttggcttcccacaaactctttcccatacggctttgccattcttcatacatgaaataacgcggcaaaccgcttccaccacgaatacccaaataaccggttaccatatcagtaataggagccccgatattagcacaagcgaatatatccgtcttcgtcaccagataactagtttggaaacctgaccaactatgtccctgaagacctatctttcccggatgcgctatcccctgctctatcaagtatttcgtaccgcttactactgcatcataactactctgtcccggtgttcctatggtaaaatgcacatccggcataaatacaatatacccattactaacaaagtacatcacatccgccattgcactactcaacattggagcatgataagtgttcagccctccggaatgtgtttcatagaactgtaccagaacaggatattctttcttagcgtcataatcttccggcaagtaaagtattcccttgttaggcttattctcataattagtccattccactaactttgcagtaccccatttgtattcgctttgttgaggattagcattcgttatacgaatcggatcagagaaatccgatttactccaccacagatcacggaattctgatatattctgacgattccagatacaatacttctgattgtcagaaaaacgatgaattgaatagatataaggaccttctgcgagcttcttcaagcgacctttcatgtcaagtgaataaataccttcatccattgtattttcatcccatacgctgactataaccgtctcgtccggattgaatacttctttgtcaatattgctggtcattttacggatagatctctgatttttgcgaccataccccttagtgatgcattccggttgacgttctccggtcaaatcgatcttccaccagtcataagcatcataaatcaacacattattaccatcagcagtccaaccagcaataccacaagcaggtgcaggatttggtttgtcataagtttcctcgaatatcggatacccaatagctgttgaaatatcggtaacctcacccgtttttccgtcaaacttattccatacttgtgcaataggatcatacatcacagcccatttgccattcatcgaccacctcggtcttgtccggtagctacgtcctaccaattgcttttctcccgtatgtacattcacagaatagatgtcaaacggcatttcattaagccagtctttctgcgcacaataaggcgtttcgtctgtgtaaagcacattatgaatctcttccgcacgatccggctccaacaaatcagcatgcccgggagctacttccgtcaattttcgggaagcaatgtcatagatatatttcgaatattgaggacggaaataacgactgcgtgtctgcaaagtaggtacttcatattcatcccaggtccacaactccagctcaagactcttatccggctttatttcctcttctttcttatctttatttattttttcctgataaggtctgagttccattgtcagaaacttctggctacttgacaggttagcccggacaagttccatccttgcagggagaactatctcttttcggtcaaagaccaaatcacaggtgttcttctttaaggaaaagttgtaccatagtgaatctttaatactgaaccctcctatcatctgttttgcattcaagttgaaagaaactggttctttctttacggaactctgataaatagtctgatagagtccggttaatggaccataacacaatgcgttacctttcgcttgtttacgtacaaagatgatagattgtccttcgttgtacaaggtataataaccaatactgtcaatttgaaaggaagtgccgttttttagatgacgaactatcaagcggtcgaaagatggaacatgattgatggtatccttcggcacatttgttacagaaattgagtaaggaattccttttgctggtcggaaagcttccttataagtccactcggtctttgtgcctgaaggcagttctaacaggattgttttcgcattcccagtagaatcggacacttgataatatgcagcttgatctgaattataaaactcaatattttctacatcctccaacagaatctccttacgggtgcgtgagtcaaacaggtgcaagatctttccgtctttgtactcgggattatattccataggaactatacgataagtcacccatcgccctgtcggagaaatatcaggcgactctacacgcatccatgacatacacgcgtcaatatcaatcggcttcttcggtgtttgtgccttaatattctgaccaaatccgatcaaaagtcctactgctattccgattcttattattgtcctgttcatcttatcttctcctttcatcttctatcatatatttattcagatcaatatctgcatccgccgaatgatcgttcaatagtaaacgtgcgaaatgacgccacattttatgttcaaagaatacttctgattcaccaaagaatccatgagtgcatttcggtagtacaaacatatcaaagtctttgtctgctttaatcaatgcatgtaccagacgtaatgtattcgccggatttacggtattatcgaccgcaccagtaaataacaacaagccatgcttgtaattcttggctagttcctgattagggcgtacacgaacactataatcataagtcgtatgctccactcccaagctatctttccctgttttcaccttttcatctacgccaaagtgaatttccacaaagcccttattatagattctgttatcatggttacccgccgaagagacagcagctgaatagaagtcgggataagtacatatagctgcagccgacatgaatcctcctccggaatgaccataaataccgacttttgtaccatcaatgaaaggataacgggcagccagttgctcaatagcatacttatcatctgccaatggatagtcacgcatattgttatatccatatgtatgatatgcttttccacgcatcggagtaccacctctatgacctacagtaataacaatgaatcccagttgcgccagacgggtattatatacatcattcacagtaaagcgtgtcggcacatactcaaaaaaaggtcccggatagacgttcgaaataatgggataaaccttcgtcgagtcaaaatctgcaggtttccacatcacgccataaagatcagtcacaccatcagccgctttcaccttaaaacgctccggagctttccatcccatctcataaacaggttgcaagtccggtttttccagtttcataaccacctttccacgtgagttgcgaacgacattgacaggttcttgtgaaactgtggagtaggaatctacaatataatggttagagggagaaattctagcttcatgtgatgcgttttcgggtgtcaacaaacgaatagcattcagttgatccagtttagcttcataaaggatataataataagggtcgatgcttttctcacgaccataaccataaaaataaaattttcgaccgacagtatcaatctttgcaatcggaccagccacccaagttccgtctgtcacctgatttttcaggtttccggtagcagtatcatacagatagtagtgtccccacccgttccgttccgaacgaaataatatttcttttccatctttcaggaaagacacgctacgcatctgataatcaaggtacggcttattctcttcatgaattacgacgcgtacctgtccagtttcgacatccacctcacaaatatctgattgattccaagagcggttataacgttgaaaatagagacgtttaccatcatttgttgtatacagtacatcgatatactgatcaggccaacgattgatatctactttcttcacttcccttttatctacgtcgccaagtaaaagttcatattgtgtcacgtctttatctcctgccaactcggctttataagtcgttaattcaggaaactttgacaatgaattgattaaccacagatcgcgcactttccgattgtcctcacgaacagcataaaaacgatgagtacccggaagccaatgagctgattcagccccgaaacgtccctccatctttccttcatcctcacgattgaatgtatagtccggtcccccgtctgttgtcaactgtacaggtattgtatcctgtccctttttcggatttccgacaaaatacaggttgtctttactggcatacaacatatacaagctatccggagaatatttcttccagtatggatcaccgtctttataaataggcttttcatcgagtttcttcaacactttcgtacgaatgttataggtatatagcccacggtcgaagtcgagacgaattgtctcattatctttcatgaaagtgaaagacagatgaggagctgcagcagagtaagcttttttggtatatactgcaatcttactcaagagttcgggggtatcaaacaacagacgtttttcctttttcttcggattcacataatagtatttctctccctcacgggtagtgaaagaatagtagaagcagtccgtatcattgatgaacgtagggttgacttccgtagaatacttcatgataggattctgtgtcagtaaacgaaacttctccgccaactgataatttgctttttgctgtgcgctggccatgctgcatattaatgcaacagccgccaagcacagatatctaaaaagagagtttttcataaaattttgtctatgtcttatttggtacagtttatatccccccaataatctgcccggttatcacccagcaagtgtttagcaaagaagcgatacatctttttctcaaaatatttatctgcagagccatatccatgccctgcaccgggtattaccaacatatcgaaatctttgccagcttcaatcaatgcttgagctacacgataagtgtgtgcaggattaacattcttatccatatcccccgtcacaagcatcagatgccctttcagattcttggcaatctctgcattagacttcacactgaatttgtactcatattctttcgtttcgttgcccaagctgtctttcacaaccttttcaacttctttcacgccattatagcattcgccccaaccacgattatagatactattatcgtgattcccggaacaggaaacggcagccgtataaaagtccggataagtgaatatagcagctgcagccataaatccgccacctgagtgcccgtatatacctactttcttgccattgataaacgagtggcgttgagccaactgttcgattgcatatttatcatctgcaaggggataatcgcgcatattgccataaccgtagcgatgataagctttaccacgcatcggagtatcccctctatgtcctacagtaatgacaataaaacctagctgtgccatacgggtacaatagctgtcatccaatgtaaagttagtaggtacaaagccgaaataaggaccaggataaacgactgaaataattggatatttcttttcaggattaaaatcagacggcttccacatcactccatataagtcggtaatattatctgctgcctttacaacaaaacgttccggctttttccaacccgatgcatagactaagtccaagtcaggttttgccaactccattatcactttgccttttctatctttcagcatgattttaggctccatgtcaactcttgaatatgtatcgatatagtaattatgagatttcaagaaattcacattatgctgcccatcttctgtacttaatggagtaactccttctttgtcaatatcaacttcgaaaagcatataatagaaaggatttactttcttatcttttccatatccatacagataaactttgcgtttcagtgtatcaatagaattaatgtagcctgttacccattcaccagaagtcatcacattcttgaggtttccatcgccatcataatgataataatgtccccagccagtacgctctgaacggaacaaaatatccttaccatcgttcaagattgccacattacgagcatgaggatcacgatacggtttatcttcttcatgaatgatctcctttacttccaaagttgagagattaaccgagcatacatctacttcatcccaagtacgtttagtgcgttcaaaaaacaaatatttgctatctgaggtaacatgaagaggcattacatactggtctttccatttgtccaccttcgctttctttgccgttttttctacaatatcaataatcgtcaaatcattttgagtaacatatttatcaccagggaactcatatttatatttgaccaatgacggtgaatcttctattgaattaattacccaaaaatctcgtaataaacggttatcatcacgcactgcatatacatgacgattatccggacaccagcgtgctagcgtcggtacttctccgtcttctgcaggttcgtaatcatcttcacgagcatatgaaaagtctttcataccatccgtagtcagttgcacttcagttgtatctactcccagtgacttatttcctttcacatacaaattatgattctttgcatacaaaatatatttcttgtcaggagaaaagttcatccaagtatagcttgggtctgatgattctttcttctcttctttcttctcaactattgtcagtttacccgtcaaacgattataactatactgcttacccttataatcgaactcaaatgaacgttgatcttttgaaaaagtaatagatgaaatgtccagtttatttttatccaccacgcctttggtgaattcacttaactgcatagccatcttacttttgtcaaaaagaggttcacgttttcctgcagcaggcatcacataatagtaatctttaccagctgtcgtttgaaaatcaaaccagaaattatctgtatcattgatttcccgcggataaatcgatagactattattagataatttacctcctaaggtaaattcctgaaactcctgtaccaactcgtaattggctagtattgtatcatgcttgccagaggcttgtccccatccttgcaatgcaaaaataaaagacaagctgccgacaataaaaactcgttttaataccataatggctattttattactatatgaatcacttttaaagctattcttctagaaagaaaatgacatataatcatcaccacttccccatttataaaggacatctacaatttctccaaagttcttattttcttctgaagtggtttcattcgggaattgctgtttaagagaaaccgccgtacacgtaccgtcttttagtcttgtttctacaacactatatatataaaaacttccgtcttccaaagcaacccctaattgcccactgtaaggatacttgtatttacgtaaattggtggtcacatccatacctgacaaggtcttgacagcagcaggcaacggctcacctaatggcatcaaactccctctatattccacatctccataagaatcccatccgtattgataataataaagctggtttccgctggcaataaccacataacgtttatttccaaaattagccataccacgataatcattgataactcctaaaggagcctcataataccaaccatccatacaactaacggatctgctatctgcctctaacccgaaataacgcaattcatatactgatgtagcttcatctttcagcaaaaccgtccaaaaaggataagccattgtaaaatcattccctccatcatatggagctggcaatgcatctaccactgtcttttttatatttgagaagtgatcttcaccactcggatcggcaatattatacatattcccactttcagaactagtcatttcgccgatagctgaactctcacttccagctacattacccacatccaaaatgcccactaatgaattatcttcttttgtcaacgcaagcatcacattcgtataatagtaattaaacttataggcttggaacaagcgactgaatcgggtttcattatttaatcctatagacatataggtacctgcatgaaaatcagccgcatctgcctttttttcccaataaattagtccattcttatccaacaatgccttagccgtataagtcatggcagcttctatcggagaaaaatgagcaggaatatccccacggaactcttcatctgtgtacacttcacgttccagcgtattgccattaagctccacccagcgatcttgtttcactaccaattcatcgtatacgctaataccgtactgaagattataatctatataaccaatgttattcatcaatcctttcggatttgatcccaaattggaaacgacatcacgcttcactatatgataaaccaatgaatcacgagtaaaggtttccccattatacgttacctgataatgttgtgttgtaggtacaatgaaatgaagcacagaacgtccgccttcatccgacagaatagtccatccacgttgaaacatagacatcaccttaataatcgtagattttccgaactggacccccgacttattgtcggtcactgcaaatgtcacttgatacgtaccgcttttgtcggctttaaatgtataagtggcaccactttcacctgtctgcaactgtttgtctatgtaccattcgtagctgacgtcgggcgtaatgctgtctatcgtaaacttaaatgtaggcgccaataccaattcgtctccctctatcaagttatatccagaattgatattctcaatattgaaattaccaccttgtaagtcattaatctgcttgtagttataattattgtcatcatccaaacaaccggacataactccgacaaaaacagtcatcactgcatatattcctaattttttcatactttgcaattttatagttatcctgccacttccacagtaatcacatttccatgctcatctttctcccaatcttcctttttctttccttcgttcatctgcttcagggtattcttcagtcttaatgaatatttacgtaatacttgcttgttctttccatcgaacaccatatcatcttttttcaactcgtccaaaaacatctgatacttcctttccgaatattcacctagataaaaccaatcgactgaattccccggattggattctgaccctgcatcaatcaccgaccaccagtgaggtttaaacaaacgatcggtaacagtaataaaagcacgagaatatgaatggtcaccttgcttcaccccgtttgcctccactacctgcaatgccaatattttcgtttctttctccagcattggggcattcttcagtatcacataaatggtatccgtgagcaatccctttctaatcctacagtctgtaggcagcacatataagtcggcaggcaaggttgtatattctgcatctacacttacattaaaatgtaaatcatcttcctgtatttgcccgtagacagagacttctatcggtatttcggcatcctcaccctcattatacattttaaaagatactgtagtcgtgtcttttgtcatatcattagcaaatctcaaataggctgtatcgttactgttgaccagcaatcccttctcttcacacgaaacgagcatcagatctgcaatacaaatcaacgctccccatatagcatattttatcttcattttcatttctcttaaatagttattatgaaaatattccttatatttaaatatttgattccgaatcaggtttcggcaataccacattctcatcagtcggcaaaatatcactactataataagagctggcggggatcaatctattcaaccgtttatacatatagaatatctgcccttcacccagaaattcacgacgggcatcatttaccaacaaatctataaactccgatttatttgtcacattatcaaacttttttgatatccctcttccttttttcaccaattccaaatagcctcgtgcttctttgggtttggtatcaaaaatcgcttcagcagcaatgtaatacacctcagacatacgtatcatagggagcatacggttatttgttttcccttcatttgtactctctgtctgtttgttatacttcaatgtgcgataataaaacccataatacttctcttccaattgatacttaaaccgccagtcgctatttatttcatccccatacagttctttcgcaacatcaccatcaagacacaaataattctcctcactggcaccatcggaaccatgatttatttcctgatcccattccaccaactcctttgaagaatagagcccgaaaataatatcattatacatcttcatatttccattcctaaagccagacgaattagttgaagcctcgaaatagccggttttattttcttcatcaatgattttcttggcttctgcataagcctctgcattctttcccgcatacaagaaaacacgagccaactccgccgttaccgcataataattcaggcgatagcctctgctttttgcaaacaggctctctgaaaccgtttcgatattgaatctagcgttcgcccccatactagatgttgcatccacttccttcagaatgcgctgtgcttccttcaaatcagcaataatctgttccaaacaataactaacagtttgatggttgttgacatagctaggataaacattaacataaggaatgaaagtacgatcatctttcccgaaaccaacagatgaaggagatggagcataaatacgaagcaaatcaaattgtataaatgcgcgcaatccgatagcctcacccaaaatcatctgccgctcaccatcaagtccactaaagagattagggtcagctttggcggcctgttgagccaattcattacaattggcaaccacattccaagcagcattccacatggcatctgtgacagggactaattctgtatttttaaactgaagcgctgccatatttctcatagctgttccaccacctatacttggagcttgatctatataataagactgcgcccaggcatccataatgccccaagtaaggttacttccatacaaattgaaagtagccatcttccggtaaataccgttcgttgccgtacggaaaccatcaccagaagagaacaaatattcctcctttatctcatcagaaggataaaggtcaagccaatctgaacacgaagagagtgtcaagactacaaacgcaaaagaaacaaacgtagtatatatttttcgtatcataatggtatacttagaattgtgctttaatagagaaatcaaccgtccatgacttcgggtaacttaaacctcgctcctgacggatagaattccagttaataaaatcgcgtgtacttgcttccaatcggagcatattcattcccaaatacttctttatccattcccgattgaaatcatagcttaaagttaatgcactcaaacgcagataagccttatcctgaacgaagcgtgaagtcggcatagtggcactatcggcatttttaatatctttaaactgcgcaatatctcccggctgtttccatctgtcggtcaacacacgcaagtctacgttttgatattgtattctggcattctccacccgatctaccaaagtctgattatactcctgcccgccccattcgtattggaaagcagcaaataagctccattgtttataagcagcattaaatccgatagagccattgaatttaggttcagtattaccaacagccacttcttgagtggcattccatgtgtcggacacactaccatcacggtttaagaatatttccttacctgtagtaggatcaatacccaaagatttcacagcccaaatggaagtaagtgactgtccttcctcatattgagaaattggtactccatatttagaattatagcggccatactcttcattcactatattctcatagaattcttttactcgctgattgtaggcacgttgagaatcagaaatttttagaatcttattcttgttgtgtgccatatttccccataacgccaccaaccagtcacgattacggaatacttcgccacgtacctgcaactcaaatccctgattcagtacttcacccatattgtctttataactagagaagccggaagtttgagacaggctgacatcgttcaccaaatcaattgttttatcatgataataatctgcatccactgtcaaacgccgattcaaaaattgcatttcaatacctacattaaacttatcagtcttttcccaagtcaagttgttatttcccaaagctttcaacactgcgccaaaacctgttgcataccattcatcaaaaagcgcttcgtacatagtcgtagcagcataagctggaaaactagctttaccagtccggccatacgatgcacgtaccttcaatttgttaactatctcatttccttttagaaactcataattatgaatgttcacccccaaacctccggagaagaacggtgcccagcgttgcttggagccaaaatcagatgacccatcaaaacgaacagagaaatcagccaaataaatatcattccatgtatagtttccggtagcccatgcactgaccatgcgtgaagtaccttcggtacgtgacggcttttcatatatttcggctgcataattcgatgaatgaaattgtccactcgggaatccgcggtaatgaacgtttgtcgcatctgatgaaccagaagatgcctcccatgccacagacagatttaaattatgtttattgaaagaacgtgtataatataaagctgcatttgcattccaattcaaactatttccatcatccacatagaggtcacccaagttatgtccactttcattaggagcagccgtggtttttgaagacagcgggtcgataaaccgttctccactagaatatttacggttcacactaaattgacctctaacagtccagtaatcggtcagataccaattcaaactcaaattattggatacttcatcataagcactccaagtataattgccaagagtcgcttcgtatagtgggttgttagcctcgcgtaaattgctattcttcgagaagctcaacctttttcgcaatgtcccgtcatcattataaggtgtatcatagggttgcaaaatggtatagtcactaaacgaaccataaggcgactctttcgatttagaatgagtgaacgatacagtgttcttcacttgcaaagacttcatacgataatccagagagaaaccaacactatagcgatcacgtcctgaccccttcatcacaccattcgctgcattgtaagaagcatctacaccccaacgcaagttttgcgtacctccctctataaagaggctgtgtttatggtcgaatgcatttcgtagaggcagtaccatccaatcagtatccacaccacgttgaatttgtgcaaatctcttattataatcaagaatttgattttccatgttactattatcgaaaagtccggcaaggcgttccatctccagtttttctgaagcatttgccagattatagtcgctcaagtcgggcatttccaccgtacctgtaaagttgtaagagacacgcacttcacctggtttcggagtgacggtagtgataactaccacaccgttagcggcacgcgaaccgtaaatagcggtagctgcagcatcttttaggatggtcatgctctctatgcggctgggatctaagtcgtataccttttcgatgctaacttcaaatccatccataatgaatgtaggcagattgggattattttccagattcgatttagacaattgattcttatccaaatctctggtacctacccctgaacgtccacgaatatacatttcaggcaatgcgttcggatcggaaccaaactgcgtattgctcatcaaacgaaaagaagggtcgaatgactgcatggcatccagaacattggtttgcgataccttacgcaactcatcacctgttatttgggtagaactaccagtaaagcttgatttacgaacattgctatatccggttacaactacatcctctaatgtcttcacatcatccaacatagtaatctcaagcatcttcttacgtgtagcatctacctgaagagtctgtttcttcataccaataaaagagatttccaaagtcaccttatcatccttaacatccaaagtaaactcaccttcaatattagtagaagtacccgtacgagtaccttttacgatgatgctggctcctggaatcggttccttattcgaatcaataaccgtaccacggatacgattatcacgcttctcggcctgcaatttacgaacaacaacaataccgtctttcaccacataatcaaatccctggggatttaaaatcaactttagagcgacttcccatttctcattttttgcattaattgatacgggaggaactcctttaaacatttgtgaattatacaacatattcactcctgtttgtttcttcactgcatccaaaacagtctcaatagagacattgtgcaggtttaaagttaccgtcttatcctgtgacggtagagcccatgtgctaaatgtgcaacacactgccactaaaaaacatagtagccatcgtttttctctcataaattaatgattaaactttacctaatattctatttattcttactctttcattccatcgtatatcagcactttccggccactgattttataagtcagatcgcctgtcagttccaaagcatccaagaaagaattgatcgttccgtaacgtttcaaactgccactgtaagttatgtcgcgtagatccggtgtttcataataaatctgtatatcataccagcgttcgaatgtctccataatctcccctaaagaacggtttttaaagttgtacacaccatttacccaaccgatatactcatccagatcgactgtacgtttctctgtgccattggcagaaactactgcttgttcacccggctgaagagttaccgttccgacattcggtgcagaaaattgaacttttccatgtaccaatgtagtgtaacaaacggaagcatcggtataagcattcacattaaacgccgtaccaagcaccatcacttcgccaagatgagtttgtaccacaaacggatgagattcatcctgcacaacctcaaaataagcctcaccttccagagctacaatcctgcgtttacccgcaaagcgtaccggataagtcaacttagaaccagcattcaaatgaaccgtcgtcccatcagcaaggatcacggtattttctcctccacgtggtatgataagttcatttgacttaaccggcttctcttcgacgtttttctcttcgtgttgtgttgtgacggttggtttatatgacagcactccttccttatattttacctggacgccatctactattacgttaacttctttcttccgcacatcaataatgctgccatcgggtaaagtcaattgtgcctgttgaactcctggctgaatcaatggtctgctttcctcttcaatcgaaccataattcgacatatagaaagagaaaccgattactaaaacaacagctgctgcaacagaccaccaaatccggaaagcacgagacttctttattacctccggttccgtttgtccgattttctgaaggaaagattcataggctttctttgatgaataatttttatattcttcaaatgcaactcttaatgtctcaccattctgcaattgttcatacactttttgtaagtccgggcattccgccaatcgcttttcaagctcttgctgttccgattcattagcttctcctaaaagagctttcttcattaaagcggcatcttgatatacattttcgaacttcttcatcttatttttcctttttaaatcaaacaactgtttaatttgctttattatagatatacataactcacagaaaagggtgacaaaaagatgatatttttttgagataagaatataaaggagaggaatttagaggcaaaaatataacattatgtcacaatacagaaggaatcagttcgtttttaacaaagaaaacaaatcttaagtaatcaataaaaagataaagatgtatcaaattgactttttatctttttagagaaataaacaaagaataatagaatgaacagagtcgcccagcctctcacgaaggaatttatagctgcgtgtcttttgagttttaacagtattgatacttatttctaaacgttccgctatctcttcccatgtatgtccttcgattctcattaagataatccggcgttgctcggacggaagttcttcgatatagcaatagagttgccggataatttcttctttcaccgtcaatgcataaatcatatcttcgtcctccacgctttcttcttcggctaaagaattcaatatggtatcatgaatttgattattgcgtatatataataaggtattattatagcaggcacgataaagataattggtaagctctttaatatcagaaaaggtacgcttcccttcccatacagaaataaaaacgtcttgtaccaaatcttctaccgcatcggggaccggcaatatctttgatacataaacacataaggcagtataaaaacgatcgtagaaatcgccccacatcttttcatccttccggtttactcccgctactatagtgtcaattttatcgttcatactgtcacattacctgcgaaaaaaggaaacagaattcataaaaatcgccgtaactacttacttttgcgacatttacgattgcaaatatattgttttttttcaaaaacgcagactttgccggcttacaaaatagaaaataaaaaagttctttctcatacatagagattttttcactttcatctttcatctatcaccagacttcttgaaacagtttattcatagcactttcaagcatggtgatagattgccggtaacctatcaccttatctatcatctatcaccaccatttatcgctctgatttcttggtttttcccttcaattttaccgggaatcttgtcctatgatagccaccagactttatttttttgatttcaaatatgagtcagacaagagaaatgctgacaaaacaatcgtaagctatagggcagcggttcgtatcccacaagacgacaatctgtttcatgctttgaaacactctgtttcattacgggaaacactttgtttcacaccgagaaacgaatcgtttcaaaccttgaaacaaactgtttcaaatagggttgaaactaattgaatccaggcaaataacaaattgccccaaaagaaactcgaacgagcttaccatacagttcaaatgagaagcaaaagaaaataatagttggaaatgaaagggcacaaaaaaagagcgaatcattccgctccacctttaaagaatccccataaatgggattcttctttttcttcatctttcatttactctttacctgaaaacgtctttctcctaatacctaatcaaaacaatctttttcctaaaaactaatcttaaaatctaataccttaattttataaactaacaccttttaattattacctttttctaatacctaaaatataagtagtttcacaactacactgcaaaggtatagctgtttgcaaaaacaacaaaagccatcatgcaaaaaattacattcagatttatttttttgacttatgtcaagacgtagggtagattttgagtgtaaaccttacgtttattcccacaacaatccgtcttttcaacaaatctttccttttactctctagttgcattcataattgagcaagcgcacaactaacaaaaagaaagcaaaacagggaatttaaaacacaatctattaccattctattcaaaaacatacaatcacaaaaaacaataagcggcctattttcgaacaatctgcatatttctaactcaaaattacggcgattttttcagtcaaaccggattcctccccggattttcagaagcaaaaacagcttgaagatacaagtctcacaacttttccgtaactttgcagcgtttgataataaataagataggaatggattttaagtacgacgtaattgtaattggtgccggacatgctggttgtgaagcagcggctgccgcagctaatttaggttccaagacttgtctcattactatggacatgaacaagattgggcagatgagttgcaacccggctgtaggaggaatcgccaaaggacaaattgtacgtgaaatagatgcactgggtggacagatgggattggtgacagatgaaacagccattcagttccgaattctaaaccgttcgaaaggccctgccatgtggagtccccgcgcccaatgcgaccgggctaagttcatttggtcctggcgggagaaactagaaaatacacccaaccttcatatctggcaagatacagtatgcgaactgctcgttgaaaacggtgaggctaccggattggtcactgcgtggggtgtcaccttcaaagcgaaatgcattgtgctcaccgcaggcactttcctcaacggactgatgcacgtaggtcgccatcaattaccgggaggaagaatggccgaaccagcttcttatcaattgaccgaatccatcgcccgtcacggcatcacctacggaagaatgaaaaccggtactccggtacgaatcgatgcgcgcagcgttcattttgaccaaatggatacacaagccggcgaatgtgacttccacaagttctccttcatgaataccagcacgcaccacttaaagcaacttcaatgctggacgtgctacaccaatgaagaagtacaccggattctgcgtgaaggtttgccggattctccactgttcaacggacagatacaaagtatcggaccacgctattgcccgagcatagaaaccaagattgttactttccccgataaagaccagcaccagttattcctggaaccggaaggagaaacaacacaagagttgtatcttaatggattctcttcttcacttccgatggaaatacaaattgcggcactgaaacaaatcccggctttcaaagatctggttatctatcgtccgggatatgctatcgaatatgactacttcgatccgacccaattaaaacatacgttggaatcgaagattatcaaaaacctgttctttgccggacaagtgaacggcactaccggatatgaggaagcaggaggacaaggattgatagccggcatcaatgcgcatatcaactgccacggtggagaagcctttactctggcccgcgacgaagcatatattggcgtattaatcgacgatttggttaccaaaggtgtggatgagccctaccgtatgtttacctcccgtgcagaatatcgtattttgcttcgtatggatgacgccgatatgcgcctgacagaaaaagcgtttaagctcggattggcaaaggaagatcgctatcaactggtaaaaagcaagaaagaagccgtggaacaaatcgtttctttcgcacgcaactattcgatgaaaccggcattaattaatgatgctctcgaaaagataggaacaactcccctgcgtcagggatgcaagttgatagagattctgaatcgtccgcaagtgacaatcgagaatataacagaatacgttccggcgtttcagcgggaactggagaaagcgacaagttcggatcaggatcggaaagaagagattctcgaagctgctgaaatcttaatcaagtatcaaggatacattgacagagaacgaatgattgctgaaaagctggcacgattggagagcataaagatcaaaggaaaatttgattattctaccattcaatccctatccaccgaagctcggcaaaagttggtaaagatagatccggaaacgattgcgcaagcgagcagaattccaggagtctccccaagcgacatcaacgtactgctcgtgctttcgggacgataggcggcaacgtttcacgtgaaacaaatcatttaaagaaacgatataattcaatgattatgagcaaagaaacactaatcaaaagtattcgggaagtacccgatttcccgatccccggaatcctgttctacgatgtcaccaccctattcaaagatccatggtgcctgcaagaattatcaaacattatgtttgatatgtataaggataaagggatcaccaaagtagtaggaatagaatcaaggggcttcatcatgggaccgattttagccacccgcctgaacgccggtttcattcctatccgcaagcccggcaagctccctgcagaaacaattgaagaaagctacgacaaggaatacggaaaggacaccgtgcaaattcacaaagacgcactggatgagaatgatgtagttctattacacgacgacttgctggcaacaggaggcacgatgaaagcggcttgtgaattagtgaaaagattaaaacctaaaaaggtatatgtaaacttcatcattgagttgaaagaactgaatggaaaatcagtattcggagacgacgtagaagtagaatcggtattgactttataaaggatttgcatctatttgcagagaatgtgtcaaaagtaagcagctagcgatctctcatacctaacgattatgaatgtagaaccggaaagcaaaaccaatgaatatttgaaagggattgtagccaaccttcccgagaaaccgggtatttaccaatacctgaatacggaaggaacgattatatacgttggaaaggcaaaaaatctaaagaaaagagtctattcttatttcagcaaagagcatgagccgggaaagacacgagtattggtcagtaaaatcgctgatattcgctatatcgtagtcaacacagaagaagatgcgttattactggagaataatctgataaagaaatataagccgcgctacaacgttctgttaaaggacgacaagacctacccttctatttgcgtgcagaatgagtactttccgagaatcttcaaaacaagaaaggttatcaggaacggttcgtcttattatggcccgtacagtcacattccatcaatgtatgcggtattagacctgataaagcatttatatcccttgcgcacatgcaatttaaacctaagtccggaaaacatacgggcgggcaaatttaatgtatgtctggaatatcatataaaaaactgcgccgggccatgcatcgggttgcaatcacaggaagaatatctcaaaaacatagatgaaatcaaggaaatcctgaaagggaatacacaagatatcagccgtatgttgctggaaaagatgcagacgttggcagccgaaatgaagtttgaagaggcgcagaaagtgaaagagaaatatctcctgatagagagttaccgctccaaatcagaggtagtaagtgctgtattgcacaatatcgatgtattctcaatcgaagaggacgagtcgaactctgctttcatcaattatctgcacatcacaaacggcgccatcaatcaggctttcacgttcgaatataaaaagaagctgaacgaatcaaaagaggaacttttgacgcttggtattattgaaatgcgggaacgctataaaagccagtccagagagattatagtgccttttgaactcgatttggagttaaacaatatcgtatttaccgttccacagcggggagataagaagaaattgctggatctttcggttctaaacgtgaaacagtacaaggccgaccgcctaaaacagacagaaaagctgaatccggaacaaaggagtatgcgtttaatgaaagaaattcagcaagagttgcatttggaaagaccgccgctacaaatcgagtgttttgataactcaaacatacagggttctgatgccgtggcagcctgtgttgtatttaagaaggccaagccatcaaagaaagattaccggaaatacaatataaagacggttgtagggcctgatgactatgcttccatgaaagaggtcgtcagaaggcgttatcaacgcgctatcgaagagaattctcctctacccgacctgattatcactgatggcggaaaaggtcaaatggaggtcgtcagagaagtcattgaagacgaactgaatctggctattcctattgccggactggcaaaggacaaccgccaccgcacatcggagctgctttttggatttcctccgcagacgattggtatcaaacagcaaagcccattattccgtctgctgacacagattcaggatgaagtacaccgttttgctattagtttccatcgtgataaacgcagcaaacgacaagttgcgtccgcactggataccatcaaaggtatcggagaaaagacaaaaacagcacttttgaaagagtttaagagcgtaaaacgaataaaagaaacctcttttgaggagattgccgctatcatcggagaagcgaaagccaagaccgtaaaagagggattaagcaatgaatcatcaaaaaatgaataagaagccggcggaatggagtcagttatctttctatcatttttagccgcggattacacagattgcacggatttcacggttaaattactaaaaaccgcattatcctttcaatctgtataatccatgcctaaataataaaccattaaagctttcggcaaaaccttataatattttcctgccaacacaccgttttctctttcgaattttgtaaatttgcctttcctaaccacgaaatagaataaataacaatgcgaatagttatacaacgggtaagccatgcgtcagtaaccattgaaggacactgcaaatcgtccatcggaaaggggatgctgatattagttggcatcgaagaatcagacgggcaggaagacatcgactggctctgcaaaaagatagtaaatctacgtatcttcgacgatgaaaatggggtgatgaacaagtctattttagaagatggaggcgaaattttagttatcagccagttcacgctacacgcttctaccaaaaagggaaatcgcccctcctacatcaaagctgccaaaccggatatctctatcccactctacgagcaattctgcaaagatttaagcggtgcactgggaaaagaaataggcacaggaatcttcggagcagacatgaaagttgaacttttaaacgacggtcctgttactatatgcatggataccaaaaacaaagaatagatattccatactaatcattaatcactaatcattaaaaaaatgactctggaagaagcacagaaacaagtggaccaatgggtgaaaacatacggtgtccgctacttcagcgagttgaccaatatggtagtcctgacggaagaagtaggagaactggcccgtgtcatggcccgcaaatatggcgaccaatccttcaaggaaggagaaaaagacaacatagatgaagagatagcagacgtcttatgggtgcttctctgcatcgccaaccagacgggagtagacatcactgacgctttccggaaaagcatggagaagaaaacgaaacgagataataaaagacatatcaacaacccaaaactgaaagatcatggaagagaataactcacagcccaacaagtacaaggccgcattggcaaagtataataccaatctgagcgatgcagatattcaagctcgcgtagctgaattgattgagaaaaaagtgccggagaacaacacggaagacgttaagaaattcctgttcaactgcattgatctgaccaccctgaacagtacggacagcgacgaaagcgtgatgcactttactgaaaaagtcaatcagtttgacgacgaatatcctgatctgaaaaacgtagcagccatctgtgtgtaccccaactttgcagccatcgttaaaaacacgctggaagtagacggagtcaatatcgcctgtgtatcaggaggtttcccctcttcacagacattcattgaagtgaaagtggcagaaacagcactggccattgcagacggtgcagacgaaatagatattgtgatttccatcggcaagttccttagcggagactacgaaggaatgtgcgaagaaatacaggaactaaaagaagtttgcaaggaacaccatcttaaagtaatcctcgaaacaggcgcattaaagagtgcttccaacatcaagaaagcctctatcctatccatgtattcgggcgcagactttatcaagacgtctaccggaaagcagcagcctgccgcaacgccggaagccgcttacgtgatgtgtgaagctatcaaagaatactatcagaagacaggaaacaagattggattcaaaccggcaggtggtatcaacactgttaacgatgcgattatttactacactattgtaaaagaactattaggtgaagaatggcttgacaaccaactgttccgcttgggaaccagccgtttagccaacctcctcctttccgacatcaaaggcgaagaaatcaagttcttctaaaaattaaaggctacattagcaatcaaatacgccttaccgcgcgactcccgtatcacgggaatcgacgcggtattttttatttaagaaaaactaaagatagttactggagaattcggaaaaataattatctttgtaaaaggtttagcgatgaaaatatagctaattagttatattagagaacgtttcatttattaccagttcctggaattcggcaaaattcaaagttatgaatggtaataagcaaacgggtctcacgcaccttcatgtatataattttgttatatatcgaatggagcgtgggactgttgcttgtatactcataacggcttgccgaagcctcaggaaaatacatggcaacagttctcacgcttttcatgaactttatggaggtattaaggatggacgcttacacaagaaccttacgattcaatcacaaccctctgaatctcatcctcggaacagagaaaaagaaggggctacgcatcggttatatggaagctggactgcaaggcttctatctcaactccatggagaccggagtccatccgcaaaagctatccagactgctggcagaagagttccactgcaccgataccgagtccgtcaccggattattccagttcctgattaacgaaggagacagagtctcctaccagattatgctcccctacttactctccacagagaacatcaacgagttcgaaagtatcatccaaaagcgctttttcggagtagaacgcttcattcagcaaggaaagaatctatacagattcgtgaaatatacagaagaaagaagagacccgattatatggataaatgacttagaaaaagggattatcggatgggacatgggattgcttgtcagcttggcgcgcgcctcccaaacatgcgggcacatcagcaaggaacaagcctggaagtacatagaacaagcagcccaattatgttcgttagatcttcatacagctgaagaaatagacaagagtttccttttaggaaaagcgatgaaatcgggaaagatagaagattgggatcgattattatcgtgctattcacttctgggcaaacaccggaggtaattatttttcgcggtctaccacgtaatccaagtaagcccggagggctacacaaatatcagattccggcaaagaagccagtaaatcaaaagccttttgcttatagatattcatcgtctgaacggcatattcaatgcccccattttctttgataaacgagatcaaatgagcaatttcatcgagagtagctgcaccctcctttaccttgattgccaattcctgcgcctcatcgttttttgtcgtgttcaatacatacaaagcgggcaatgtcagtttaccttcaagcatatcattacctgttggtttgccaatctctctattatcaaagtaatcgaaaatatcatcttttatctgaaagcagataccaatatattcgcccaacaaacgagccagttcggcttctccctcccctacacctaccgaaaaagcggcagctttcgtacaggcagcaaaaagagcggcagtcttcttacggattacatcaaagtaaacctcctcagaaaagctatgattacttacatttgaaagctgaagcaactcgccgtcagcaagatcctgcccaagagtagacaccagttgaataatgcggtggctgttcgtcagttcggcatgcaccaaactggttgccagcagatagtcgcccgtcaatacggctactttattattaaagatagcattcaccgagagttgtccacggcgttcggtactttcatccacgacgtcgtcatgcaccaaactggctgtatgaaggagttccaatgaaacagctgcatgaagagtggaaggacatacagcaccataaagacgtgccaccagcaaaacaagaataggacgcatcatcttaccattcctctgccgtatgtgagatacgacactatcgagcaatgcatttgaactggagagagaactatcaaaaagttctttgaagtctcttagttctgcttcaatcggagttctgatgagtgagatgctgtccattaattacacaatttgagcacaaaagtaataataaaacgctgaataccgtatttttttgtacttttaccatgaaaaattaattaaatctatggattcaagtaataaattatttcttttagacgcttatgcactgatataccgggcatattacgcctttatcaagaacccaagaatcaattccaaaggattcaacacttcagctatactgggttttgtaaacaccctcgaagaagtgctgaaaaaagagaatcccactcatataggagtagccttcgaccctgcaggacctaccttccgccacgaagctttcgaacaatataaagcgcagcgtgaagaaactccggaagcgatccgcctttccgtgcctattataaaggatattattcgtgcttaccgcatccctattctggaagttgcaggctacgaagccgacgacgtgataggtacgcttgccaccgaagccggtcgccaaggtatcaccacctatatgatgactcccgacaaagattacgggcagttggtaagcgacaaggtatttatgtaccgtcccaagcacacaggaggtttcgaagtgatgggtgttgaagaagtgaaagccaagtttgacattcagtctccggcacaagtgattgacatgctcggactgatgggcgactcttcggataatatccccggatgtcccggagtaggagaaaagactgcccaaaaactaatttctgaattcggaagcatcgaaaacttattagagcataccgaccaactgaaaggtgcactgaaaacaaaagtggaaacgaaccgggaaatgattactttctcgaaattcctcgccacgattaaaatcgatgtgcccatccaacttgaaatggattctcttgtccgcgaagaagcagacgaagattcacttcgcagcattttcgaagaactggaatttagaacgctcatcgaccgggtactaaaaaaagaggtttccggaaatggaataacctccactcccaaaagcaaagtagccaccggaaaaagcgccccctctcctcttccactttttcccgaagaaggaggcggaatacaaggcgatttgtttgcgaatttcacgcccaatgagccgaatgaagcaaaaaaatcgaatctagagacgttagaatcgcagtcacgtaactaccaactcattgatacagagaagaaaagaagagaaattattcaaaagttacttacatcgaaaattctctcattagatacggaaactaccgggaccgaaccaatggatgccgaattggtcggaatgagtttttccattgccgaaaatgaagcattttatgttcctgttccatcagaccgggacgaagcgttaaaaatcgtaaaggagttccgcccggtcttcgaaaatgagaattcgttaaaagtcggacagaatatcaagtacgatatgatcgttcttcaaaattatggtgcagtagtaaaaggtccgcttttcgatacgatgatcgctcactatgttcttcaaccggaacttcgtcatggcatggattacctggcagaaatttatctgcattatcagaccatccatattgacgaactgataggccccaaaggaaagaatcagaagaacatgcgcgacctcgacccgaaagatgtatatctgtacgcttgcgaagatgcggacatcactctgaaactgaaaaacgtattggagaaagagctgaaagagaatgacgccgaacgtttattctatgatatagaaatgcctcttgttccggtattagtcaatatcgaacggaacggagtattgctagacacggaagcactgcaacaatcatccgctcatttcaccgcccagatggagcaaatcgaaaaagaaatctacgaactggccggtgagaccttcaacatcgcttcacccaagcaagtcggcgaagtcttgtttgacaagctgaagattgtagaaaaagcgaaaaagaccaagaccgggcagtatgtcacctcggaagaagtgctcgaaagcctccggcataaacatcctgtggtagaaaagattctggaacatcgcggactaaaaaagctattgggcacgtatatcgacgcacttcccctacttatcaacccacgcacaggaagggtgcatacctctttcaaccagactgtaaccgctacgggacgccttagctcaagtaacccgaatttacagaatatccctatccgcgacgagaatggaaaagaaatccgtaaagcattcatccccgatgaaggctgcctcttcttctctgccgactattcgcagatcgaattgcgtattatggcacaccttagcgaggataagaatatgattgatgctttccttagcaaccacgatattcatgctgccaccgctgccaaaatctataagattgatctgaaagatgtagattccgacatgcgccgtaaagccaagactgccaatttcggtatcatctatggcatatccgtatttggtcttgccgaacggatgaatgtagaccgcaaagaagccaaagaactaatcgacggttactttgaaacttatccgggagtgaaagcctatatggacaaaagtattcaggtggcccaggaaaaaggttatgtagaaacaattttccaccggaaacgcttcttgccggacatcaactcccgcaatgccgttgtacgcggatatgcggaacgaaatgccatcaacgcccctatccagggaagtgcggcagatattataaaagtagcaatggcacgtatctatcaacggttccaggccgaaggaatacaagccaaaatgatcctacaagtacatgacgaattaaacttcagcgttcctgtcaatgaaaaagagcgtgtagaagaaattgtcatcgaagaaatggagaaagcataccgcatgcacgtccccttgaaagcagattgcggatggggcaaaaactggcttgaggcacattaaaccatcaagtggataaaggccacctcaataaggaattgctatcttttagatactaattgcgcagggagactccaccttatccggggtttccgcttacaaaatagaagcaagtatggataataacattatttaactcattatccagaaagctagaaaaaggaatcctttttcgacgaagtgattcattctatatccggcagattgactgccggatatttttttgtcaccaatcttggcaaatagcaacccatctccgaccctacatcttgacattttgacaatattttatcttcaaaaatgcataaataccaaattaatatgtagatttgcagcgtaaaaccaatgcatttgatagacaaatgaaagtataactcaaaaacttaaatagccatgaaagcaaaagtatctttaaaaatgttcgttttatctacagctcttcttgttgtgtcgcttgctacttctgcacgtagctacgataatcaattgatttataatccaatcgaagagaatggtatgacagtgggacagaccgtttacaaaatggacggaaacacacttgccaactacatgaagtacaactacaagtacgatgacaataaacgtatgattgaaagcgaagccttaaagtggaatagcaacaaggacgaatgggaaaaagacctacgcatcaactatacgtatgaaggcaagaccgttaccaccaattattataaatggaacgctaaaaaacaagcctatatactggtacccgaaatgactgttacgatggataatacaaatatgtaacataaactctctctcattctaatattctaacaaaaaagatacgccgcttctgctgaagaagtggcgtattgcaatttataaggtctacattacaaaacaaagaaacgttcttgcagttctttcagataacttcgagaaatcatcaaatcgtttttatcgtgaaaaggtggatagagttggcaacacttaccatcaatcattgccaaataattaacatttacaatagccgattggctaatctgcacaaaagcttgtgaataactgataatatcttctgcttttgtattccgcttcaaattcaggcgagtctgattaaacaagactacctgccattgacgtttgtctttcagatactcaaaaaagccgatttcttccaggcgtaaaagcttgaaacccgtcactgtgctaatcataaacatgccttgttgtggcattaatgcactgatagaagaggcaaaagaaggcaaaagaggaagcgcagcagaggtcattgccttccggtaacgctccataatcactttcaggtcttccgcctcaaaaggctttaacaggaagtcgaaagccgactcacgcaatgcctgaagcaagtatttatcataagaggtgtaaaacaccaccttcatatcccacaaaatatcctctctaatttcacttagcaggttaagccccaatgtatccggaagctccacatcgagaaacaataaatccggatgcaactccataatcatctttttaccctttgcaccattccctgcaattccttttacttcaaattcacgatagggctctaactcgcggcgcaaagcatcaatcgctgtacgttcatcgtcaacgatgactaccttatacttttcttctgtctccatcataaatcataagaaaaacgaaacgggatatataccgacacttccgtaccggtttgtccatcgcttctgttggttatattaaaacgtattttatcactcttgttctttgtattcagtaattgaatggtctgatacaacactttcaatcctgtaccagtaccccgtgtggcggaaactacctgcgggagatacccgcgtccgttgtcggtaaccgttatgcgaatcccatttgtttcacgggaaacatataccattagctccttttttccgtcctttcccgccagtccatgtttaatagcattctccaccggaatttgcacaatcatagatggaatcatgatgcgggttgcatctaaaccgtcctccaccgtgattgttgcgacaaaatcttctccgacacgtccacgttccagttcgatgtatgtacggacgaaatccagttcgtcttgcaaagatacgctcaatttctcggtaagttcgaggctacgacggagatatttcaccagttccatcagattatgtttcacctcttccgagccgttaaactgattgatctcacgtcccagtacattaaaagtaaaatgaggagaaatccggcttctcaaattctccatgcggacacggttgatttgctggaagaaacgctggcgaagaaactccctctttttacgcatataccagacaactaccactacccctgccacaagcaacacgcagacaagtacccagatagatacgctcaacttgagcactctcatctctgccgcctgtcgctgaatctgcatttctttacgaagcacgattgtatcttgccggtagcgcatatccagttcggcaacacgcatctgtactcgttcgctacgaatggaatcatccagatgacaatcgcgtttcagatactcataggcatggcggtaatcaccaatctgctcaaaataatgttgtagatactgattgcgtatagtcagcatattagcgtcaagatgcccgacaggagcagtccgggcaatcattgttttcgcttgagctatatttcctttcttcaataccagttcaatcatctgggtttcgatgtaatgtacggccgagttatgctgtatatcggagaagaatcgataactctcgtccagacagacctgtgcggagtccagtttgtcagtcagcaggtacaattctcccaggtttactttaataaaattctgttcaaacaccatctgcggataagaagagacaagcacattggccctgcgcatatacttcaaagcttcctgatagtctttccggtaataataatgattaccgcgattgttgagataagtccatcgttcgctcacgttcatctcatcgaaatactgtccggccaattcatagtaatgattggataaatcgaaatcccgcagttccatataggtttgccctaatccgtagtagacagggaatttcgcgtgctcggacaagtttagcgaatcacagagaaacagggcacgacgataatacgaagcagtgtgtgccaagtcactgcgatgcaggtaggcatcagcagtattgatacaaatatccgggagcaggtgcagtttttttcctttcagacgatattcgtaagctttcttatagtcggtaattgcagaatcagggcggttcagttgcatccacacgttgccttcgatattataaacatcggataatacatcattccattgtggagattggagagattcagaagattgggaagcattgcggaaaaattcctttacccggcgattgtaatagagtatagaatcaaaatcggaagagacaaagaatgttttcccataaagggcaagcaaacgatagtaaacctgggaatcttgcgcctgtgtcagtgcgtcaagcacctgtgagcgggaataatgcacattggaaaacaaagaatcctgtacacgaacttccagagaatcaaccaacacctgttcgcacgaagagttattgcggtgtctatcagcatatccgcaactcaacaacatcaacaaccccaacagtccaaatagtttcatagcagtcttccgattcatcagtccccttattcatgtcatgttttgaatgtgacaaaaatacattatttatcctgaatcccagcgaattttattattttttttaatacctttgtgcccatataaatatgagtaactgacctaatgagtccactgaacttcacccacattttgacacaggcagtcgatgagctatcggaaagcgaatcttataaaggactgtttcatcagcacaaagatggcgaaccactgccctctgctaaagtcttgtatgaaattattgagctttcacgctccattctcttccccggatattacggaaattctactattaacagccggacaattaattatcacatcggcgtcaacattgaaaaattgtttgacttactttgtgagcaaatcctggccggattgtgttttagcacttccatagaggggaaatgcaacgtctgctccgactcgaaacgggaagaggcagcacgtcttgctgctaaatttatcagtaagttacccgccatgagaagaatactggcaaccgatgtggaagccgcctataacggtgacccggctgccgaaagctatggggaggtaattttctgctatccggctattaaagcgatcagcaattaccgtatcgcgcatgaactgctggaactgggcgttcctttgattccccgcatcatcacggagatggcgcatagcgaaacgggaattgatatccatccggccgcaaagattggcactcacttcactatcgaccacggtacgggtgtcgttatcggtgccacgagtattatcggaaataacgtcaagctatatcagggcgtcactctgggagccaagagtttcccgctggatgccgacggaaaaccaatcaagggaatcccccgccatccgatcctggaagacaatgtgattgtttattccaacgccactattttgggaagaatcaccatcggacgtgacgcaaccgtaggcggtaatatctgggtaacggagaatgttcctgcaggagcaagaatcgtacaaactaaagcaaaaaaataaaatcaaaagaatctatatgagcgaacaattcgagatgatagccaagactttccagggactggaagagatacttgcagaagaactgacagcattaggagccaacgacattcaaataggacgccgcatggtttcattcacaggagataaacgtatgatgtataaggcgaatttttgccttcgcaccgccatccgtatcctgaaaccaattaaaaactttacagccaaagatgccgatgaggtttataatcaaatacaggctattccatgggaagaatatctcgatgtgaacaagacgttcgctatcgatgcagtagtattcagcgatgagttccgccattcgaaattcgtttcgtataaggtgaaagatgcgattgtggattatttccgtgataaaacaggaaaacgtccgtcggtacgtatcaacaatccggatgtacttctgaatattcatattgcacagactacctgtacgttgtctttggactcgtctggagaatcacttcaccgtcgcggttatcgccaggaagcagtagaagccccgttaaatgaggtattggctgccggcatgattctaatgaccggatggcgcggagaatgtgatttgatcgacccgatgtgtggttcgggtactatccctgttgaagcggcactgattgctaagaatattgctccgggagtattccgtaaagggtttgcttttgagaaatgggtagatttcgatgcggatatgttcgatgagatttacaatgatgacagtcaggagcgcgaatttgctcataagatttacggatacgataacaatccgaaagctaatgagattgcgactcacaatataaaagctgctggcgtatcgaaagacatcgtgttgaagctacaaccgttccagcagtttgaacagccacaggagaagtcgattatcatcactaacccgccatacggtgaacgtatttccactaatgatttgcttggactttatcagatgatcggtgaacgtctgaaacatgcgtttgtaggaaacgaggcatgggtgctttcttatcgggaagagtgtttcgaccagattggtttgaaagcaagtcagaaagttcctttgttcaatggaccgttggagtgtgagttccgcaaatatgagatttttgacggaaaatacaaagagttcaagagccaggaagagggagaagaaaagaaagaggctgaaggagaacaggctccaagatttagagaaagaaaagaatttaagccacgccgcgaaggtgagttcaaaccgcgtcgggatggtgaatccagacctcgcagagagggagaatacaagccgcgcagagaaggtggtgagttcaaaggtggtgatggaagagatagaaagccacggggagaattcctcggaggaagagattcgagaggcccgagagagtttaaaggaaatcgggagccgaggattccgaagaaggaagaggaataaaccattcaatagttaatgacacattataacatcacacactcattaacaccctgataaccaacttgaggtcacaaattgcaacctcaagttcaaataacattttcgccaataagctatctatgatagcaaccaattaaagaaaaaatgaacgacattgttatcattgaaaataaaatttatgagatcagaggtcaaaaagttatgttggactttgatttggcggagatgtatgaagttaccacaggtaacttcaataaagccattaaacgaaacatcgaacgatttcctgcaagattcatgtttcaattaaataaagacgagttcaacttgatattccaaaatggaatatcaagttggggtggtactcgcaaaatgccttacgcttttacagaacaaggtgtagcaatgttatctggagttctgaaaagtccccgtgctattgaagtcagtattaatattatggatgccttcgtccacatgcgtcaatacctactctcccatgctccgaaacaggaattggaagaattgaggaaaaggattgaatacttggaagaggacatatcctccgacagagaaagctacgagaagcaatttgacgacctattcaccgctttcgccaagttgagtgctgccattcaaataaagcagactcccttggacagagtaaaaatagaaggatttaaaaacaaataataaagaaaagagcaatgagtaaaattggaaaaagagccatgcttttattgttggcactaccaatcggattcaatgttatggcacaagaaaccaaaaagccgacactggaagaattgattccgggtggcgagagttaccgctatgcagacaacctgtacggactgcaatggtggggtgacgaatgtatcaagccgggcgtagataccctttattctatccaacccaaaacggggaaagaaacaatggttatcactcgtgaacagatcaacaaagtgcttgaagagaacaaggcaggaaagttatcacacctgtattccgtcagtttcccatgggccgataagccacaaatgctattcaagatagcaggaaagttcattgtatatgatttcaagagcaatcaagttgtcagcactctcaaacccaaagacggagcagataatgaagactattgcgcagccagtggaaacgtggcatacacgataggtaacaatctgtatgtaaacgagaaagcggtaaccaatgaacccgaaggcatcgtttgcggacagactgtacaccggaatgaatttggtatcaacaaaggcactttctggagcccgaaaggtaacctgctcgctttctaccgtatggacgagagcatggtgacacaatacccgcttgtagacatcactgcacgcgtaggcgaagtgaacaatgtacgttatccgatggcaggcatgacgagccatcaggtaaaagtaggcatttacaaccctgccacaggcaaaagcatttatctgaacgcaggtgatcccacagaccgttatttcaccaatatcagctggtcaccggatgaaaaaagcctctacctgattgaagtaaaccgtgaccagaaccacgccaaactttgccggtacaacgcagaaacaggagagccgatgggtgttctctacgaagaaatgcatcctaaatacgtggagccacaaaacgcaatcatatttttgccgtgggaccctaccaaattcatctatcaaagtcagcgtgacggctacaaccatctttatctctttgatgccgatgcagccaacatgaaaggtgaaacttataacagtgccaacggtggtacttatttccaggccggcaaagtcaaacaactgaccaaaggcaactggctggtcagcgacgtcctaggattcaacacaaagcgtaaagaaatcatcttcacagccgtagaaggcttgagaagcggacatttcgctgtaaacgtgagcaatggaaaaataagccaaccgttcgagaactgcaaagaaagcgaacatagcggcatgcttagcgcttccggcacttatcttatcgaccgttattcaacaaaagaccagcctcgcatcatcaacctggtagacaccaaaaacttcaaagaaacagccaatctgctgactgctgaaagcccttacgaaggctaccaaatgccaagcatcgaaaccggaacaatcaaagcggcagacggcaccaccgacctgcattatcgcctgatgaaaccggccaactttgacccggccaaaaaatatcctgtcatcgtatacgtctacggaggtcctcacgcgcaatgcgtcaccggaggatggcaaaacggcgcacgcggatgggacacatacatggcaggtaaaggctatatcatgttcaccatcgataaccgtggcagcagcaaccgtggactggcatttgaaaatgctaccttccgccgtcttggcatcgaagaaggtaaagaccaggtaaaaggcgttgaattcctgaaatccctcccctacgtagacagcgaacgcatcggcgtacacggatggagcttcggaggacacatgactaccgccctgatgctccgttacccggaaatattcaaagtaggcgttgccggaggcccggtaatcgactgggggtattatgaagtaatgtacggcgaacgctatatggatacaccggaaagcaacccggaaggctacaaagaatgtaatctgaaaaaccttgccggccaactgaaaggtcacctattgattattcacgacgaccatgacgacacctgcgtgccacagcacaccctgtcgttcatgaaagcctgtgtagatgcccgcacttatcccgacctgtttatctacccgtgccacaagcacaacgtagcaggacgtgaccgtgtacatctgcatgagaaaatcacccggtactttgagcagaacttataaaactgacaaagacaccaccgtatccatacgaatcatagataacagtataaatccataacaatacaaagatgaagatattattactaggctcgggcggccgcgaacatgcactggcatggaaaattgcccaaagtccgaaagttgaaaaactatacattgctccgggaaatgccggaacaactgccgtaggcgagaatgtcaacatcaaagcaaccgattttgaagcaatcagtgcttttgctctaaaagagaacatccaaatgatagtagtaggccccgaagatccgttggtaaaaggaatctacgattacttccaaaaccgtccggagctaaagcatattgccgtgatcggtccttcggctcaaggagcgcaactggaaggcagcaaggagtttgccaaaggcttcatgatgcgccacaacatcccgacagcccgctacaaaagcattacttccgaaaacctcgaagagggcctcgctttcctcgaaacgttggaagctccctatgtattgaaggctgatggcctttgtgccgggaaaggagttctcatccttcctacgctggatgaagcgaagaaagaactgaaagaaatgctcggcggcatgttcggttccgcatcggcaaccgttgtgattgaagaattcttgagcggtatcgagtgctctgtattcgtactgacagacggagacaactacaaagtcctccctgtagcaaaagactacaaacgtatcggtgaaggcgacaaaggattgaatacaggcggtatgggtagcgtaactccggttccgtttgctgacgaagtatatatggagaaagtacgcacacgcatcatcgaaccgaccatcaatggtctgaaagaagaaaagatcacctacaaaggtttcatcttcctcggtcttatcaaggtgaaaggtgaaccgatggttatcgaatacaacgtccgcatgggcgacccggaaacagaaagcgtgatgttgcgcattcaaagcgacctcgtagagttgcttgaaggcacagcggcaggcaacctgaacgagaaaacactggtgatggacccacgttcggccggctgcgtcattcttgtcagcggcggttacccagaagcctacgaaaaagaattccctatcagcggactggaacaagctgccgccaccgacagcatcatcttccatgccggaacagccatgaaagacggacaagtggtgacgaacggaggacgtgtgattgccgtttgctcttacggtgcaacgaaagaagaagcactggcacagagctacaaagtggcagacatgatcgacttcgacaagaagtatttccgccgcgacatcggattcgatttgtaagaaccaacctgtaatgatacgccacggcaggcataaatcccctatttgtacggcatatagatcctacaaagcgatgatatatgcccgccggacggcaaaagaactgacagaccaatgagaaataaaagactacaaagtcaagtgacggcaggacggtggaccctgcctgccgttatctttatctgcgccctatgctgggtgttgacttactttttatttcccgactccatagcctcaacaacacccaaagacagctcttctttcttgcaatccacccgcgatttactgcttccgggatgggcagaacgaattgtcagctttctggtttacgcaatcatcggctattttctgatagagctgaacaaccagttcagcattatccgcatgagggcttccatgcagacagctatttatttcctgctagtcaccgtttgtccgggaatgcatttactatacataggagacattgtcgccctcggttctcttatttccatttattttctgtttaaaagctatcagcaagctcaagctgcgggctatctattctattccttcttctttatcggagcgggaagtattcttttcccacagctcaccatcctctcggtgctttggttgctcgaagcctaccgtttccagtcgctcactccgcgtagtttctgcggcgcgctgctcggatggatgctgccctactggatgctgttcggacacgccttcttctataacgagatggagttgttctaccgccctttcaaccagctattagctttcggagaagtctttaacttacaaatccttcaaccctgggaattggctatactgggctatctgctcgtgatgtttatcgtcagtgctgtccattgcatcgctgccggatttgaggataagatacgcacacgtgcctatctccagtttttgatagacctgacgctcttcctgttcctgctgattgccttgcaaccgatatattgcagtgccctgctgcctttgcttatcataagcaacagcatcctgatcggacatttctttgtactgaccaatagtaaaagttcgaatgtgttctttatcatttcattggtcggcctcatcctcttatttacttttaatatatggacgcttttgtagattcaatgatacaactcctcatagaatggggacttccgggattattcatctcggctttattggctgggagcatcgtgcctttcagttccgaactggtattggtggcattggtgaaactcggcctgcccccgatagcctgtctgatatccgccactctgggcaatacagtgggcggaatgacctgttactacatggggcgcctgggcaaaattagctggattgagaaatatttcaaggtaaagaaagaaaaggtagacaaaatggtgaaattcctgcaagggaaaggggcattgatggcattcttcacctttcttcctgccattggcgaagtgatcgccattgcactaggatttatgcgaagtaacacatggcttactattgtttccatgtttgtcggcaaactgatacgttatatccttctcctgtatgtgctcgaaagtgcctgggatgctatggcggggtagaggccttttttaagtattaagtattaggtattaagtattaaagattgagtgatggaaagaataattgagagaaccgatgacgggagcgctactctgtttgttccggaattgaatgaacattatcattcaacgaaaggggcacgcacggagtctcaatatattttcatcgatatggggctgaaagcctctcctgccgctactccacgtgttcttgaaatcggcttcgggacaggattaaacgcttggctcacccttgaagaagcggaaagaagcagacgaaatatacactatacaggactggaactctatccactagactggcagacagtagaacagctagggtatatctccagcgatgagcagcttaccatacatcggaagcagacagcaaccgatgagcaatttaccccgaatgatgaagaacaacaaccggctatcgaattgtttaagcagcttcatacatcgccctgggagaaagacgtgcagcttacgccacacttcaccttacgaaaaatagaaacggacgtcaatcaatggataacgggaaagaaggaagagtcaaaaatgaacagcaccaacaacaatgcagtcatttctcaatactcaacttccaatactccgtttaataccatctatttcgacgccttcgccccggaaaagcaaccggaaatgtggtcgcaagaactattcaaccgcctctatgttttattagatagagacggaattctgactacctactgtgccaaaggtgtagtacgccgaatgttgcagacagccggattcacagtagaacgcctccccggacctccgggtggtaaacgggaaatattacgggcccggaaacaagagtagaaacaagataagattgaaaccccgaaacagaaaaaatcatgaaacaacaactaaaagatatgagaacacttttccttcttggtacctgcctcctgatagcagcctgcacaggacgttcctcccaggcaagtaacgatgacgagacaaagccggtgataaccgtcacactggaaccgcaacgttatttcaccgaggctattgccggagataaattcaaagtagtcagcatggtgcccaaaggttccagtccggagacatacgatcctatcccccagcaacttgtttctttaggagacagcaaagcctatttccgcatcgggtacatcggtttcgaacaaacctggatggaccgcctaatgaacaatactccccatatccaagtgttcgacacctcgaaaggaatcgacctcatactcaataatgatgaccatggccatgcccacggccacaacagtcacgacggccatatccacgccgtagagccacacgtatggaattctaccggtaatgctttaatcatcgccggaaacacctacaaggcccttagtcaactggataaagcaaacgaaccatattatagaaaccgttacgattctctctgtcagcgcatccagcacaccgacagcctgattcgccggcaactctccacccccgaagcagccaaagccttcatgatttatcatccggccctctcctacttcgcccgcgactacggattgcatcagatttcgatcgaagaaggaggcaaagaaccctctcccgctcatctgaaagacctgatagacgtctgtcaggcggaaaatgtaggcgttatcttcgttcaaccggagtttgacaaacgcaatgcggaaaccatcgcgcagcaaaccggaacgaaagtggtccctatcaacccgttaagttatgactgggaggaagagatgctgaatgtagccaaagcccttgcgccgcaagctgccactaaataaacgtataaagaaagaaccaatcaagccctttccaatgatgaaaccaataatcgaaataaagaatctttctgccggatatgacggtcacactgttctccacgatgttaatctaagcatctacgaacgggattttctaggtattataggtccgaacggaggcggcaaaacaacgcttataaagtgcatcctcggtttgttaaaaccaaccggaggggaaattatattccatactcccgagaaggctcccataagaacatctacggaagggacttcgacagaaacatctgccaaaaactcccaccaaagttcttccgcgaaatcccagcttttcctcggttacctaccgcaatatagcaccatagaccgaaagttccctatttccgtggaagaagtgatcctgtccggattgagcatacagaagtcgctcacctcccggttcactcccgaacagagagagaaaggcaaacagattatcgcccgcatgggattagaagggctcgaaagccgctctatcggacaattaagcggtggacaactgcaacgtgccctgttaggacgtgccatcatctcggatcctgcagtgttgattcttgatgaacccagcacgtatatcgacaagcgtttcgaagcacgcctttatgagttattagctgaaatcaataaagaatgtgccattatccttgtcagtcacgacatcggcactgtattgcaacaggtaaaatccatcgcctgtgtcaatgaaacgctggattaccatccggacacgggcgtcactaccgaatggctggaaagaaacttcaactgccccatcgaactattgggacacggcacactgcctcatcgggttttaggggaacatcatcaccatcattaaaggatacacatattcaatatcccaaacatatatatacagcaacccaagtattaatacctgaaatctcaaccattaacagctgatattacaagtgttaacacctaacgtccaagctattaatagtaaacttccgttgtattaatagtaaacttgttcttctctaacaggaaagttatgattgactaaggataatctataaacgcaagttacgtttataaaattgaaagctttgtttttataattgcaagtttcatttataaaaacaaaacttgcaattatagtttatgactaatgaaaaggaagtttgttattaaggcaaaagaagttcactaacaggataaaggaagtttatctctaatacaccagagcttatttattaaaggactaaaaataatttccttacttgccaacacacaagttcccgccttccggaagagtgaaagagatagtaaatcagccctccgttacttaatatttcttactttcttcctcattatccttacaaatcactatctttgcgacctcataatttgtttttaacgaataaactacgatagtgctaatgaaacagtacagaaccgtaaacaaccttatgggttggcttacattcatcattgcggcaaccgtctactgcctgacaatagaaccgaccgcaagtttctgggattgcccggagttcataaccaccggctataaactggaagtcggacacccgcccggcgcgcctttcttcatgctagtggcgaatctgttttctcaatttgcttccgacgtaacaactgttgctaaaatggtgaattacatgagtgccctcatgagtggcgcctgtatcctgttccttttctggagcatcacccacctggtacgcaaactggttatcactgacgaaaacaatatcaccaaaggacagcttatcacagtgatgggtagcggactgatcggtgcactggtttatacattcagtgacacattctggttctcggccgtggaaggtgaagtatatgccttctcctccctctttaccgctgttgttttctggttgattctgaaatgggaagacgtagccgaccagccgcacagcgaccgttggattatcctcatcgcctatctgaccggattgagtatcggtgtgcacttattgaacttgctttgtctgcctgccatcgtattggtatactactacaaaaaaacgccgaatgctaccgccaaaggttcgttaatagcgctattaggttcaatggtgctcgttgcagccgtgctttacggcatcgtaccgggtatcgtgaaagtaggcggctggtttgaactgttgttcgtcaacggactcggaatgtcattcaattcgggcgtagtggtttatatcattctgcttgcagccgctctgatttggggtgtatacgaaagttacaccgaaaagaacaaagcgcgcatggctatctcctttatcctgacgatcgctttgctgggtatccccttctacggacacggagccagcagtatcatcatcggtattttggttattgccgcactgggactttatcttgctccgaatgtacaggctaaaatcaaagagagatggcgtatcaccgcccgcaccatgaacacagcattgctgtgcaccatgatgatcgtaatcgggtattcttcttacgcactgatcgttatccgttctactgccaacactccgatggaccaaaactcaccggaggatatattcaccctgggcgaatacctcggccgtgaacaatacggaacccgtccgctcttctacggccctgctttctcttcgaaagtggcactcgacgtaaaagacggctattgtattccgcgccagtcggaagcaggaagcaagtttgtccgcaaggaaaagacttctcccgacgaaaaagactcttatatcgaacttcccggacgtgtggaatacgaatatgcacagaatatgtttttcccgcgtatgtacagctcgtcacacgcaccactctacaagcaatgggtagacatcaaagggcatgacgttccttacgaccaatgcggagaaatggtaatggtgaacatgcctaaccaatgggaaaatatcaaattcttcttctcctaccagttgaacttcatgtactggcgttatttcatgtggaactttgccggacggcagaacgacatacagggtagcggagaaattgaacacggcaactggatcaccggtattccgtttatcgacaacttgctggtaggtaatcaggaactgcttccgcaggatctcaaaaacaataaaggacacaatgtattctactgtctgccgctgattctcggcttaatcggactcttctggcaggcttatcatagccagcggggtatccagcaattctgggtggtcttcttcctgttcttcatgacaggtatcgccatcgtgctctacctcaaccaaacccctgcacagccccgtgaacgagattacgcgtatgccggttcgttctacgcctttgccatctgggtaggtatgggagtggcaggtatcatccgtatgctgcgagaatactgtaagatgcaggaacttccggcagccgcactggcttcagtgctctgtttgttcgtccccatccagatggcgggacagacctgggatgaccacgaccgtagcggacgcttcgttgcccgcgacttcggacagaactacctgatgaccttacaggaaaaaggaaatccgattatctataccaatggtgataatgatactttcccattgtggtacaaccaggaaacagaaggcttccgtacagatgcccgcacctgtaacctaagttacttgcaaacagactggtatatcgaccaaatgaaacgcccagcctacgattccccttcgcttcctatcacttgggaccgtgtggaatatgtagaaggacaaaatgaatatattcctatccgtacggaaatgaaggctttcatcgacagctatttcaaacaggcaaacgaactggctgcacagggagacactaccatattatcactcgttcactccatttttggtgagaatccatacgaattgaaggaaatcatcaaccgttggatgctcggtaagaacgaccagttgaaagagcttctcaaaaagactggaaaagatatccaactgccgcttatccctacggacagcatcgtaatgaaggtggacaaagaagccgtacgccgctccggcatgaagataccggaagctctgggcgactctatccccgaatacatgacaatcacccttagagacgccaacggcaacccgaaacgcgccctctacaagagtgaactgatgatgctcgaaatgcttgccaatgccaactgggaacgtcctatctatatggcaatcaccgtaggaagcgaaaaccatctgggcatgggcaaccactttatgcaggaaggtcttgcctaccgtttcacaccattcgatacggacaaactggacagcaagatagacagcgaaaagatgtatgacaacctgatgaacaagttcaagttcggcggtatcgacaaaccgggtatctatatcgacgagaacgtgatgcgtatgtgctacacgcaccgccgtatcttcacgcaacttgtaggccagcttatcaaagaaggcaagaaggataaggcactcgccgcactcgactacgccgaaaagatgattccgtcatacaacgtaccgtacgactgggcaaacggcgccttccaaatggcagaatcttattaccagctgggacagaacgagaaagccaacaagatcatcgacgagcttgccaacaaatcgctcgaatacatgatctggtatcttagcctgaacgataaccagcttgccatcgccggcgaaaacttcgtgtacaacgccagcttgcttgacgccgaagtccgcttaatggaaaaatacaaatcagaagaactcgcgaaacattactccacgcaactcgaccaactttataacgagtacgtgacaagaatgaaagggaaataaatagtaagtattaagtatcaggtattaagtattaccataggcttccgacatgttttccgcatggataatacttaatacttattacttaatacttgtttaacacagactctcatgtttatagaacaaccaccttggcttttccgggcgttgtatccacaagctatcttccggatggatccgaatgaacgggcagtctatctgacttttgacgacggccccatccctgaagtaactccctgggtactggaagtattggaaaagcatcatgttaaagctaccttctttatggtaggcgacaatatacgcaagcacccggatgaataccggatggtggtagaacacggacaccgcatcggtaaccataccttcaaccacatccgtggatttgaatattctaatcctgattacctcgcaaacgccagaaaggtagacgaaattattcattccgatctcttccgtccgccacacggacacatggggttccggcagtattataccttgcgctatcattaccgcattatcatgtgggatctcgtaactcgtgattatagtaaacggatgcgcccggaacaggtattgaacaatgtgaagcgctatgcacgcaacggttccatcatcactttccatgattcactgaagtcttggaataacggtaacctgcaatatgcacttcctcgtgccattgaattcctgaaagaggaagggtatgagttcaagatgttatagaaacaacctttgagaaaacaggaacttcgaaaagaacagagatttttgaaaaaagtctccaatgagcccaaaagctccctgataagaagataaaaatataagccgaggtcttacgccccggcttttgtagtttaaggcctgtttcgtgcccgaaattgggagatcactcctctttcttataagatgtcagtacaagcgcatttcgcccggcaaagggaaaaaagagggcaaaataaccggtattcaaaaagtttctgattcacattaccctttccatccgtatttttttatacatttgcaacggtctcttccgcagaaagcctccgggtggcgagggagagatgtttatattgagaagacgtttacaagcgtttgtcatttatgttcaaaacttcgcaaactttgacctatcggaatgactaacagcaacaaagacgtcctcctgatgtgtatttatatacatccgtgcctcactttgataaacaaaggggggctacgggtgttgtacatatcggcgtgggctttctgcgttgttcgttcccgataattggcattgcgaaggccttgaacatggaacggacgaaggtgagagattcccacgtattctatgctaatatcctaatctcttattccgtttaacaataaattaacgggaagaggatgttttcatgatgcaaaaataagaattttaacgcaatcccccaaggtttcagactgaggcgaaattaattatagtgacggtatccggcaaagatagtgacggtatacaacagtgatagcgtcactatcccgagcatataccgtcactattattttccaggactatctatctggaattgtacgtttattcatatcagtgaatattacgcataataatatgatgtacatttccaatgactcctgtttgctttcctagttcttaatttgttctttctaatcctttagcagcctcaaccaaacgaatgaattctcttctatatcctttatcatcgttattcagtccctgtttggccagatcaatcactttgtcgtaactggcatttcctttaaagtcagactcccggagtaactgtccgaacatagccactgcagaagcaaagcggaaatcggaagaaacattatttcctttattatctacgaaaggaagttccagtttcttgctgacatctttatccggggctttataacgcagtttcacagtcaggagttcattagagcctgtcggcttcacggatactttctctttcttctgatatttcaagtcgtctattttacctacatattcattctttactcctgtaggaatcacttcgtaaaaggctgtcactgtatgtcccgcacccatatctccggcatctttagcgtcattattaaagtcctcgtctttcaacagacgactttcgtaaccaaccagacgatatgcctgcacttgggaaggattaaattcgacttgcagtttgacgtcttttgccactgtatgcagcgtagcaccgaattcgcctaccaaaacacggttggcctcctgcaagttatctatataagcatgattgccatttcccttttcagccaacacctgaatcttcttatctttataattacccatgccataacccagtacggtaaggaatactccactcttgcgttctttttcaatcaattgttccaatccttcagcggaagaaacgcccacattaaaatcaccatcggagcaaagtatgatacggttattgccgttagagatcagattcttcttggctattctatacgctaacaagatacctgcaccacctgccgtagagccacccgccgttaattcatctatcgcttcgcgaatcttctgtttgtcgctacccggagttgcttccagtttcacaccggcactgcctgaataagtcacaatcgctactttatctttatcacgtaagttatttaccaataatttgagagatgacttcaccaaatccaaccggttggctccccacatagaaccggagacatcaatcaggaataccagattagatgcaggcagattatccgtcgggatttcttttgctttcaggccgatacgtacaagacgatgattggtattccagggacagactccggattccatggtaattttcacaggatcacttcctgtcggcttcggataatcataagaaaagtagttcactaattcttctgtacggatagcatcaaccggaggcagttcacctttattgataaaacgacgcatattactataagaagcggcgtctacatcaatagagaaagtagaaagcggagtatccgacacactcttgaaaccattctcctgaaactctccgtattcttccgcatttacagcatcatacatgattcccggagtcggacatactgccttgtaagcagtagacattacttttgcagctcttgtctcatggccgtatcctaccaccacacattcttccaataccagttcgtcggctttcattttcacatccagcatggccgattttaccacccttctctcttgcttatacccgatatactggaacaacaacgtttcccctttcttagcctgtatcgtgtaccggccattcatattcgttaccgtacctttcgtagtaccctttatctgtaccgaacagccaacaagcggagttccatcctttgcatccgtcacagtacccgacacggtaatagcttgcgcgttcaccatacctaaagaaacaactgccatcagcagtacgagcatcattgctctgaattgatttgttttcataacttcattatttaaaatgttactaatagttcgcttttactatagagatgcagatttcacactgattccataaatgacttgaactttttttatccggcagaaaaaaagagtcctttcaaaattctcccttattcctttgccactcatcagatgatgtgtatatttgcgaatcataaacatatcacaaatatgaaaaacgaagtcgacggaaggcgggaaatagcctcgcgaaacacggcctgggctaataacattgcccgcaaactaactcattggggtgtcactcccaatcaaatttccatgatgagtatattcttcgctatggtaggttgcctcctgctgattggcacagtcatttatcccggcttcaataaatatgtagcctatatcctgttcatcgtttgtatgcagtcacggttgctctgcaacctgttcgatgggatggttgccattgaaggaggaaaaaaaagtgccaacggagatctttataacgatatgcccgaccgttttgccgatgcattattcatcattcccgtcgggtatgtagcaggtggattcggagtcgaattgggatggctgggcgcccttcttgctgttatgacagcttatttccgctggataggagcctacaaaacacatcagcatttctttaatggtccaatggccaaacaacaccgcatggcattgctgacactgacctttgtagtcgccacctgcaccatccattcaggatacgaccggatggtatgcttcatcgccctaatcattatcaacatcggtcttatcgcgacactgatacatcgcctgtacctcatgtcacacacaacaaacactgaaataaaatgaaaaatctactggataaaatattccctacgctaagcgatgagttgattattgtcatctcgcttatcatcggactgcttgttacggcaagccttattcttttccttgtaaaaaagatatctccgaaaacaaatatcagcgaactcgccgcacgcacgcgctcatggtggatcatggcgggtatgtttatcggtgctgtatttatcagctataacatctcttatttcttccttgcctttctctctttcattgctttcagagaactttattctgtattgggattcagagaggctgatcgcggagcactgttttggggcatactgtctatccccattcaatattatctggcttaccttgcctggtatggagcattcatcatcttcattccggtagtcatgttcctcgtattgcctttacggcttgttttaaagggagacacacacggaatcaccaagtcgatggcactgttgcaatggattctgatgctttcggtattcggtatcagccacctcgcttatctcctgtcgcttcccgaactaccgggattcagttccggtggacggggcctgctgttgttccttgtattccttacggaaatcaatgacatcatgcaatttatctggggtaaacttctcggacggcataagattcttccgaaagtaagtccgaacaagacatgggaaggtttcctgggcggtgtcatcagtaccactgtcattggttactttctcggtttcctgactcccctctccgctcccaacgttattctggttagcgccctccttgcgattgccggattctcgggagacgtggtcatctccgctatcaagagagataaaggaattaaagatatggggaacagtattcccggtcatggaggagtattcgaccggatagattcgctgtcctacactgctcctgtattttttcatttagtttattacattgcatattaaacggagagaatggaaaaaagattcatgcaagctgctgcgatgcagattatatataaaggtgttttccaatggttcctaaaattaatcgtaggggttcagttcaccgattgccgcttccttaaaaaagaaaagcaattcattatccttgccaaccataacagtcacctggacaccctaagcctgttggcttccctgcccggcgatcttttgtggaaagtcaaacccgtagcagcagaagactatttcgggaaaacccgctttcaggcttccatcagcaactttttcatcaatacgcttcttatcagaagaaaaggggaaaaagattcggagcacgatccgatccgtaagatgcttgaagccattgatgccggatattcactgattctttttccggaaggaaccagagggaaaccggagcagatgggaaaaataaaatccggcattgcccgtatcctatcgctacgacctgaagtgaaatatattcctgtattcatgaccggtatgggacgctctttacccaaaggaaagatgatcctgttgccatacaaagcatccatctattatggtatgcccgctttggtaaagagtacggatacacatgaaatattagagcagataacaggtgattttgaaagaatgaaagaaaaatatcaagtcgttatcgacgaagaagaggaatagatgttgtttttcaaaagaaacatatcgaaactatcggacgaggaattactgatacactatacgaagtccggcgatacggaatatttcggtgaattatataaccgatatatcccgttactgtacggactttgcctgaaatacctgcatgatgaagaccgggcacaggaagcagtcatgcagttgtttgaagatttattgcctaaactgggaaattatgagataaaagttttcaagccatggctctaccgggtggcgaagaatcattgcctgcaacttttacggaaggaaaataaagaaattccgttagattatacggttaatattatggaatctgacgaatttctgcatctattaagtgaagaggaaagttcggaggaacaactgaaggcattacatcactgtctcgaaaagttgcccgaagaacaacggaccagtattacgcgtttcttcctggaagagatgtcgtatgccgacattgtggaacagaccggatttactctgaacaatgtgaaaagctatatccagaacggaaagcgaaatttaaaaatttgtatcaagaaacaagccctatgaaactattggactacatacgaggactccgcaaaggaaaagaggcccaccgactggaacgagagtcgatgcaggatcctttcctggccgatgctatggatggttacagccaggtggagggaaatcacgaacaacggatcgagaaactgcggatgcaggtttcagctcattcggcaaagaaaaagaacacccgtgctatcacttggagcatcgctgcctgtctggctatcggattcggtgtcagcagttatttcctgttcctgaaaaagagtatgacggacgaagtgttcattgccaaagagagtgtttcctccaagttggctgaacccgcaattccgcccactccggctattcctgcaactccaacagttccggcaactccacaaaaggaaatcgcattggctaccgcaaaggtaaaaacagattccactcctgcttccgaagattccactcctgtttccgaaattactgcgagacaagcggataagaaagatatgattgccaaaatccaagcgacttcccaaccacaacaaggtgtgccggtgatggaggaagtgtcggaagagactgccgcattgcaagaagtagtagcaacgatggatactttcgaatctgaatctgataagaaaatgaagttggctaaggtagcgactatccttcctcaaaagaacatgattaaagggagggtgaccgacgaaaaaggagaaccgcttatcggagccagtgtgacatataaaggaacgaatatcggaaccatcacaaatatgaatggagaattttcgttagtcaaaaaggatgataagaaacgattgacagcggagtatatcggatataatccggtagaaatccggatagataccaaccggacgatgctcattgccatgaacgaaaacaaacaggcactcaatgaagtggtggtagtgggatacggcgctaagaaaaataagaagtcaacaactaccggaaatgttgtgacggttaaggaacaggcaaagaaagagattactccgcaacctgtcatcggtaaacgtagctatcaaaaatacctgaaagagaatctcgttcgtccaacggatgataactgtaaagatattaaaggggaggtagtcctttctttctttgttgatgaagaaggaaagccacaaaatatcactgttattcatggattatgtgaattcgctgataaagaagccatccggcttgtcaaagaagggcctaagtggacaagtggaaaactcccggcaagagtaacagtacgattctgaacttaataaataccaataagaaggcacatttgtgccaacacagtggcacaaatgtgcaaacaaggtggcattgttgtgccaacctattggcatagtaataacaacacaaagcctatcttaaatcagttcgtaactagccatctgtattggcatatccaaattatgaagcactttctccaatagaataccctcgcggttatcatattcatacccgaaagtggcacggataccttgcaggataaactgtgtggcacggtccaatgccatcggcagactgtctccctgcatcaaagagccggtgatgacactggtaaaagtatcgcccgtgccgggataatgtgcaggcagataagggcaggtcactttccagtagcggtttccctgacggttatatgcatagacagatgttttatgaggctcatcatgtacaggaacactggtgatgataaccacttgcggacctttgtcggacaaaagacgaagatattctttcagttcttcatccgtgttatctgctttatagggtttatccaataaataaaacagttccgtcagattgggggtaatcacatctgctttcgtgattaagtggcgcatttcttttatcatctctccatcaaagttggtgtataatcgtccgttatctcccaacaccggatcggcaacgatcaggctgtccggccgacgaaagtccctgataaaatcagaaacaatctgaatttgtctcggagaacccaagtatccggtatagatagcgtcgaactctacctccagtttcttccattgggcaataatcttcggcatctcgtccgtcaggtcgagaaaggagaaaccgggatattgcgtatgattggataatacagccgtaggaagcggacagacctgaaaacccatagatgaaagaataggaatgacgacggtcagagatacgcgccccattcctgaaaggtcatggacggcggctattttctttactttattggcatacatataatttataattaaacgttttactactcttatcctacgaactcatttatctactatggacaaacagaaacagatattctatttacatcaaaggacattcgactatattctccaaaagcctctactacattagatgaaagccggactttatccaaacagagcctctatttacatcaaacggaagctctgtttatatgaaacaaaggctctatttcttaccaatagagcctctgtttttacagcgtcaacagagtctccatttcgtttgtactaacaaatataaaactccattgttttgaaaccaaatttattttagaataatcaacagagaaacattaggttaatatcactaacacgtcccgtgccccatgcgctcccatcactaaagcctgctcaatatcagcagtctttgacggaccggagatgaacgttccgaactgatattcctgtccgtccagttcgcggtaggcgtcatacatggtatctacaattttattccggtcgagcagaataaccaacttttccgagataaaatagattgctttatatttcaccgcctgcggtatccagatggctccgttttcggccactccgatttctcctttcactacggcaacatctgtgccgtccaactctttcggatcatccaaattatcgggattgaatgtagcgcaggaaatatccggcaatacggaagcaatgcgcatggcgtccggataagtccggcgtatgaccgcattcacatcttccccttcacccaatacaactgccgtaccccccaccgcacggctgattgcacagaactgttctatcttatcaggatatgacaatcgtttcatatccgcaatatccggtttatcataacgcgtctgcgtatgctggcggatgctggctaatatatcttctctgctgctcatttggattcctcctttccctgtactttgtttttcttccacatttcattgaacgactcgctggcaaattccggcagttcacgcccctttccccaatcgtcgagatcgttgtatttcatgaaacggggcaggccatttaccaccggggctgcccacaaggctgcgttgaacaatgccggacgctccatcaggaatttcataccaccggacatgatcttctttcccgtattggctttccccagtccgtccaaatcctgacgccatttgtaaatttgttcggccaaatctactttcaccggacagacatcggaacaggacatacacagagaacaggctgaaagattatcataatacttctccggagcgtgagccatacccaagttgatgccaataggtccggggatgaaatacgtataagagtaacctccactgcggcggtacaccgggcaggtattcatgcacgcaccacaacgaatacagttcaatgtcttgatatggtcgggcttggatagtaaggcactccggccgttgtctacgatgataatatggtattcaccgccttcgcggggacggcggtaatgagaggtatatgttgtcaccggttgtccggtggccgaacgggcgagtaatcgggtgaacacacccaatgcgtccaaatccgggacgatcttttccataccgaaagcggcaatgttcagtttcgggtaggaagtacccatatcggcatttccttcattggtacagaccacaatgtcaccggttgaagcgacggcaaagttggcgcctgtcatggcggcttcggcattgaggaagagatgacgcaggttcttacgtgcggcatgagtcaggtaggtcggatcaaagtttcccttttccgtgcccatctccttttcgaatagttcgcctacctgttcccgtttgatgtgaatggcgggcagtacgatgtggctcggttcgagatgcatcagttgcaggatgcgttcgcccaaatcggactctacgacatcgatgccccgctccatcaggaaaggattcaatccacactcttcggcgagcatggacttgctcttgatgaaatggtggacgttatgctcattcagtatttcgtagacgatggcgcagtattcatcggcatcttttgcccaatgtacgatggcgccgttggcggtagcattcttctcaaactccagcagaagttcttcgaggtggctgttggagtatagtttcaactcgcaagccttgttgcgcaactcttcccattcgggaacttccttgctcatcttgtcccttttggcacggaccatccaaagggtttcattatgccatgctgccatcttgctgtcctgcaagaacttttcggcagcctttgaatgttttgtactcatgattgcgacgctagaatttctacaatatggataatctgaataggcagatgctcccgtttgatgacaccttgcatgtgcatcaggcaggaactgtccgctccgacaatatactcggctccggtagcgatgtgatcttttaccttatcacgccccatgcagacggagactgcctgctcttccaccgcaaacattccgccaaagccgcaacactcgtcaatatggctgggctcgaatacttcgatgccttctaccagattgagcaggtcacgcaatttattgtaataagggatgttcagttcggtgggagcggaaatcaacagttcgcgaaccccatgacagctattgtgaatactgactttatgaggaaagcgtgcaggaattttggaaggtttcaagacatcgtgaatgaactcacaaatatcataaatctttcccgcactctgacaaacatgtccttctttctccaagatgcccggatgattctctttcacaaatgccacacaactggcggaagggccgacgatgtaatcgtattcccgaaacagatcgtcaaaacggagtgccaatttcatcgattcatcttcaaaaccggcatttgccatcggttgtccgcaacaagtctgatccaacggataatcgacgtctactcccaaacttttcaatagtctatacgatgccactcccacattggggtaaatagcattgatataacaaggaataaacaaacctactttcatactatattttgtaataatttaagcttcttccgcatcacccgtctattttgttcaacggatgtcgattaatttgtgtgtttgcaggctgagtctccatttgggatgtcgcattacacagtccactgttgaagcagtgttattacaagaacaaggctggaggaaaaaatgttcggccggaagtagttcaaaaatacttatatcttgtccttcatagaccactttcacttcatccatccggtcgatggcaagtttcgccccttgttttggggagcaggtcacccagtcgatagctgccggcagggggcgtgtaccgttggtttcgatggtcacatatttgcctgcttggtgcaaacggtcgatcaattcatcgtctatccataaggaaggttcgccgcccgtaaggacaacggtgacggcaggatattttttcacttcggcgataatttcatcgtcggtcatcatttttccttcttcgtgttgtgtgtcgcaaaagtcacatttcaggttgcagccggaaaaacggacaaagatggccggagttccggtatggtagccttcgccctgcaagctgtaaaagatttcattaatctttctcatcatcaaaatttgtttggtttgctattcttgtccttctgcgctgccggaatctttctcgtagatgacaatgtttccttccgattcctgcacttctactttatagcattgaggaatctgtttgcatacccaccgggcgatattctccgctgtgggattaaatgggagtacttcgttcagattttgatggtcgagtttctccgtgaccacttctttgatgcgggtgaaatctaccaccattccttcggagttgagccgcgcggaacggcaatagacggtgataatccagttgtgaccgtgtaaactggcgcatttactgcgatacgggagtaccagcttatgagaagccgagatctccatgcgtttgattactgtaaacatgagtgtatgtattttaatagttacacgcatctaatgtcacctcgatgcaacggcaaaggtaatataaaatagagttttcatccagcaaagagtgttattttttccctttttttgcactatctttgccgcatgaaaactctatatattgttttaggtagtatttcccttgcgctcggcattctcggcatctttctgccgctactgcccactaccccttttctattgctcaccgccgccctttatttcaaagggtcaccccgattatataactggctgctcaatcatcgacacttcggtccttacatccgcaatttccgcgaaaacaaggcgattcctctccgtgccaaaataatttctctcgtattaatgtggggaacgatgctttattgcattttcttcctgattccttttatatgggtaaagattctcctgggattgatagccgcaggagtcacttatcatattctttctttcaagacattgaaatagtgtgatagtccctgccgtgcatcggcaagtttatcctcccaatgtttcacggagttctggccaataatgtcagtcacgtatttcacggaaataaacgggatttcttttgaacggcagacaaatgcctgtgcgtatgcttccatatctacaacatctccgctaacgtgagtcaactcggtgaggaagccatctcctgtattgcagattccatgttccgtccaatgcgtgcaataacctttttcttcgagcagagctgatgaatcgacctcacactccaatccgaactctttcattttctgcatatcacggtctacaaacttgcggcatacaaagatgtctcctacctgatggttgactgttccggcacttccgatattgagcaccaagtccggttgtacctgacggattgcctctgccaaatgaaaggctgatttcactttaccaatacctgtacgaacgtagtaaggttctatatccggccatttaagttctacaaattcgccttgtatggcgtaggttactaatattttcaacatgggtttctttatttcacaaattattattatccaatgagatatgcaaaatacttatataccaaatcgtcgattgacatctccttttgttcaaaacgcattttatccaatggagaaattctttcctctacagttttttgcttcttatacatagaagatatataatcatttccatcacgatttatcagtacagaatcagtaaagtcagctactcgggtatctgattctacataatttaatgtgtatgatacatccctgacacgcccctgtataggcgaaagaattccctttgccactaaatccttcacatccctggtagctgtatctaatgaaacttcggccaacttgctccaattttttgcagtaagttttccttcatagccattcagatatatattgaggatcattcgttgtctttcagttataatgctccccgaatgagttttccaaaaaatcgctttattcaatatgccgcttaacaagccattggattcatcaatagcccgtttaagacaagccagataccattctaaccattctgtaatatcaccatttccacgttgagcctgttccagcatacgataataagccttcttttccttattaatctgcatagacatactaaagaatcgcaatttactgcgatctgtctgggataataccatatctgatatagctctcgcaatacgaccattcccatcgtcaaacggatggatacatacaaaccagaaatgagcaattgcagactttaataatgacggagctatattgggggcattaaaccataaaagaaatttatccatttcgtcatatacacgttccggcccgggagcacgataatgtattctttcccgcccaaatgtaccggaaacaacctccatagcttcagtacgataacttcccactaaaatatcagaaaagccacttttacctgttgggaaaagtgcggaatgccatccgaataatctatcatgtgttaacggagtttcgtaattcattatagcatcaagcatcatctcgaccattccatcaatataatgcgtcggttctttcacatcgggtacagttacacctaattttcgggcaacggaagaacgtacctctgctgtattcaaagttactccttcaatttctgaagatgcaacaacatcatgcgtcacagcttccaccgtagcgatcatctgactatcaaatccaattgtacttaaccttccaacaagatatccgatagccctgtttgtcagggctatcgcatctgacaatctttcagcgtcccatctgaatgaactccaattttctatttcatggataaacataccatcagttatttctgcaaaaataactattaaattggagttatctataaaaatgcggttaaaagaggtatgataagccgcaaattttgcggttaattaatgagattaaaccgcatttaataaaaacaaggcatattcaccacgcttggtttgaagaatcattcaaaccaagtacgaaacttccttatgtggagtacccaatattactttttactatccggcaacggattaatagcccccctttgtgtacaagtatatgccgatacatctaccgctttgcggtgtgattcagcgaccgacgcccctctaagtatgttcacaacaaaggtagcagtaaacgagtcgcctgcacctacagtatcagccacctcgactttaggtgtatctatggatgaaatttccccacttacatcatatatgccactacgtactgcgccctgtgtgaatataacatatttgagcgaaaaacgagctatgagttctgcgatagcttccacaaaatcagtagaaagagaaaggagagagatcaataatggcaattcgtcttcattcaatttgagcacatttgccttttgcaaggattccacaatcaagtctgtcgaataaaaatgttgcctgatattaatatcaaacaccttcaaagaggtatccggcacggcatctatgagtctcaagattgcagcacgtgacttttcacttcgttgtgccaaagagccccaacaaacagcatctgcatcgctgacaagtttcatggtcgcaggactacactcgatagcatcccaagcaacattctcaacaatctcatattgcggtacaccggcctcattcaacgacacaagcactttacctgtcggcaaaatattacgggaaatatatcctaaatcaagtccggtctctttaagcaccgtaaatgtttcatcaccgagttcgtcgccacctattgccgtaacgggatatgattctgctcccaattccttcgcaaaaaagcagaaattgataggcgctccgccaagtctcttaccttccgggaagcaatcccaaacaacttctcctatacctattattttcatggttttatagtttaataattattttcatggatgttgcaccattctcatctataaatttatatgccttgtcatactgttcgaacggaaaatgattcgaaataagcggttcgagacagatagctcccgaacttacctgatcgatagccgtaagataatcttcatggcgatacatcatcgttccgttcaccttcagttcgtgctctcccaaatagaacatattaagcgacggatccttgccaaataccgccactacaacgatggtactccctttttcgatacactccataagcgaacgaatactcgactcaaccccggcaacctcaaacgcagcttgaaaatcttcatccccgaaaagcctcttcgctccttctttgagcggcgtcttagctacattgagcgtatctattatgccacatttacgagcgatttcaagtctgaaatcacttacatcggtaataagaacccgtttggctcctcttgccttagcgaactgcgccacgaggttaccgattgttccggcacccgatacaaccacattcttacctttcaagtccccgccacgcatggttgcatgcgcagccactgccaccggttctatcatagccccataatcaagtgacataccttcaggcaataccgcaatcctgtcatcatcaaccacaaaaaagtcttgcgcagctccatttgcctgaaaggcttgcactcttagctcttcacaaatattatactctccccgctgacaaggcttgcacttcccacacgcgagttgcggacgtgcggtgacaacgtcacccgccttgcagatcgtaaccgccgcccccgtagcgactaccactgccgaatattcatgcccctgaactaccggatagaaagttgccggatgacatccgtgataagaatgtatctcacttccacaaataccaattctcttaatattcagaagtacctgatgttctttcaggtccgacgccttaggcgcctcaacctcacgaaattcaatatgttttggttctactaataccgcttgtctcattttataccatatttacttaaaatttctattaccggagtctctattgacttcgcccaaagtgcatatccataactacttggatgagttccgtcgaccgatgtctcatgcgcatcggaagcatcaggcgtaatcagataaacgtctttatatttcgggttcgtgcggatttttgcaaacaactcctctacggttgccgccttagcccgttctttcgcatcaagaactgtatcgaatgaacgtcgttcacgatagatagtacgctgaaatatcaacggagtagccggatgtgccgctataagccgatcgataaacggcatcaggcgctctcttatcagttctgcgtcaggatttgaaaaagtatcgaatataaaggcatcagccttgacttccgcaagaacatcgagcatgtaaggctgcatcaggcaacgtccgcttgttgcgagtgacacgacttgaagaccagtattacgcataaattgcatgggataactcataccggatcgatccgtgctcactccctgcgtaaacgaagagccatataccgctatcctgtgacgaaaatcggacttcaacggttcgataacagcatcgtcatctatccctatcttacaagaaatgacctccgaatacatcggcatatacatcatacattcgtgcatcgtaccatccatattctcaatgagcatgaatgtctcggttttctcgcccttatacgctttcaatgaaccgcttgccgcatactgccattgaccgtctgcatttttgatataaagatcatatcctttataagagatcggcatggttgaatggctcgaatatacatatccccactttgtcgtaatctgtatattacgcgtgttcgttttaaacaacacagccataccggcagagcaacggagttgtcgattctccgtcctgttaaaacctttataaaccaatgtatcgactctatgatacggattgggagtcgattcaaacggcttacctatcaggttaagcgttgacgcctccgtctgtttttgtgccgaaaccgacaatacgcacgaaagcgacagaacaaccgttatgaaaaacttcttcattgccttggattttttagttgtttactgtaataagactttcaatccttccgctacctgcatagcataaaactgctcatacttttccataaacacaggatatttgtccagtcccaatgacacaaaaggtgatattttcaagaactcggccgacgatcctccagaaatcaacttcctatccgccggggtgatgtgaggttcggagatagctatattttcaccggactcggtgcgcgcacctatcaggtatttgcaataaacagctatcaggaaagcctctatcgaaatatccttcccatcctgcaacatctgtttgagtatgggtaccacataaacggcaaacttggcaatgccatcgccgcaaagccgtgatacctgatcgctgatcgccttgtttgaaaatcgttcgataagctggtctttatacgcttcaaggtcaacgccttcgggaaccggaacataaggagtaacgtccctgttcataaacagctttatcattgcacgatacctctcgtctgccattacagcatcgaccttcctgaatccttccatataggcaggataagaaagaagagtatgtgacgcattgagaagacttaatttcatgatttcgtacggggtcacatcatgggtgaatgtaactcccaccttctcccatgcaggacggcctgcaatgaaattatcttcaatcacccattgtataaagtcttcacaacacacatctgtaaccttacccggttttgttacgggagtgattcgatccaccatcgaattcgggaacgtcactttctttttcgcccacgctgccacctcgggatatttcgcttcgaagtatgacataaacgcacatttggcggcattgccattcatctgcatgttgtcacacgaaagaatcgtaatcggcaaatctttctccatccggcgtttaagtccttcggctacataccagaacacactgcgcgattggttaaaatcaaccttatatcccccttcggtaatggtgagagagatgatttttatctcctccgatgctattttagcgatgataggctcactatctatttccccccatgccagttctacaagcgaaccaatcagcatactatcctgttcgccggaagggctgcatgtcgtcaattgatatatgccgtcgtctttcttgagggcgttgaacaataccccgtccgtaggcataatcatggctccgaataccccccagcatctttgtgacggatcttcaagtaatagatttgtgtaagcttcgagatgtgcacgatggaagtttccaacgccgaaatgtactattccggcctttatttcagcacgattataattaaaagtcttcatacgataatttcaatgtttcggcaagtgatttttccaccttgtcgcaatgttctatatagaatttataaacctcattccatttataataagatgcttcaaccgcttccaacggcaaccggaggtctttttcattcagcataaacttaactaaaacgtccggattgccttctgattggtaaaagatcatctgaaggttcgcacccatcggaatatcccagtacttccaactccgcaacgcttctttggaattaccagcctcccgcgcccacgttccggcttgcagatttgtcaagatggccatcagaacgccatcgtgtccgaagttgagattgatgccatgacgcttgcgaaccagatcttcggcagattcgtctaacaaatggcgtaacgtgcgggatgcaagtccccaactacgcccgtgagataccggttcaggacctttctgcgcaaaatacttatagttctcgatttctgcccaagccaatatttcctcttctgtaaagatatcccatataggcacttggcggtcgaggcattgcatcagtgatgccattaaccagaaacgatggatcaggtcgtacttgtcatactcactttctacttgcgtaacatctataaacagtcttgtaaaaaaagcatccacatccaacttttcatctatatatgaacgatatttcttataccaactgttttctttaccgagtatatacttatcaagcggactcctgtcgggacatacgttaccgtatggattcagtgtggcaaggaacgaacgggagttgtctatctccgcccattcaagcccgggacgcagcgacaaaatgcccgaatttacagattgcatggtggccgccacccgaagcacattcgttgcgttagtcttcaaatagggatggccttcaaatacttccggataattttgtaccatcctccggcctatctcccttgtctgacgataaccgatttgcgtcagatcgccttctttgtaaaacacattcttcttgaacggttcaagacgttcgtacagggctttcccaaaatcggtaaggttgtttgtggcatgagctttctccaatacgccgtatatggcaggataagtcacctcatcgtctatctgacgcgctccatgacggaaatagccgtttatatagaaaggcttatatcctttgggcgccggcgtaaccggatgtgaaagatcggtcacataatacacgccgcccgcacgttccggatccctgcgtatctcgtcgagaggattttcggtcaccggcttttctttcggaagagagagtttgaatatgcaaggaagatcggacgtctttttcgcattcgtattggtattgacatacataactccgtctttgaccacaatatcttccggttcgtaaataacctgttcctgcacattgtaccgggcagtaatcgtccgcctatccgtatcgtacacccggatgcaggaaggacggctgtcatcctgtttcccaactccgaagcagaaatagattttaccatcatgcatacagcccgcttgcgtgaaccatacctcataggggaacaccacctgatcgagaatgtcattttcgtcgaggcgcacctttgcgccctcactcaacgatggtatgcggaatttggtggcgacatactggttttcccatgcatgctttgtcaccttcgccacagtacgtttacgtgccgagaatatccatataaatccccgttcccgatcgaccagccagcttggtgcaccaaagatggggacataccctttctccgcccacttcgagccatcgagttcaattgtctgtgcgatttcgctgctaaaacgttttccacgacgggtgatgctctccacaaaacacaaccattccaactcgcttcctaccttcccgtttgtgatatacaagagaggaaacgatgctccgcgttttgtctcgacgccaaagcatacattatttacatggttgtccggatgggaggacgccaactcaaagcctgccacaggtttcggatcggcacttttgaaatcatagatattcacgtgccctccatcctcgcacgagaatatgtaatcatcccatatttcaagtccttgctgtgcccgcccccgtccttcctttgccaggaagacagagcactctacctctttctccggctctacatacaactgggcgataaggggaatagagatcagtaagcacacgacagacaaatagatctttttcataagtatgctctataaatttaaagtatgattatgttctacgttaatcgaacagctctacgcctaacgactcaagccgtttctgcaactctcctacatcgagagcccgcggagtacagtgctgcgacgcactcatggcagcagcaataccaactgcctctcccatcgccatgcaaatactcatgacacgatatgaagcgtgagctctgtgagtacccgatatacaccgtcccgccaccagaagcccttccaagcccaacgggagaaaacaacgatacggcaaatcgtatggtttgcaatattggatggttggttccgcctgtccggctccgtcaggattatgtatatcgacaatgaacaatgctttatgtaccaccacatcggcaaaacggcagccttccgccatttcatcggcatcgatcacatagtcgcccatcaccctgcggctttcgcgcactccggttgttgtaccacttccgatcactctacagttttcgtaacccggcaaattttctttcaagaattgagtcaggaggcgtatctgttgcctaagttcaagatcggcggtgaaaatagagcttaccgaagtaatatccaccctattgacttgtgtcgtatttacctgacggcaacccggtctgaccgacggatgcaaacgcacggcagcaagcatccggggaagtttgccctcatcggctttctttttacaccaatcaagaaaacactcgccattcaattgaacattgtctacatctccaatgcagataattcctttcgactcatctacgccatcaatggtgtattcaagggttacaggctgcatgagtccgtcagcacgtcctttttctatttttgcaccggcaagaaaagatactatggcatcaccggtacaatcaattgtaaccgcggcttcaaaacagagcgtcccctcgttacttgcacacttaatgccttttaccacctttccgtcacgaataacatccgacacgcaacattgcaaaaagacatcgacgttcttttccctggcgacaaattctgccaatgtaagttttgcctcttcgaaatcgtgagcatttccatgttcgccaatccagtcattgtcttcgacgccaagaatagcacaaacctcatcgcgcatcgtgttcttgcttacactaccgagaatagggccgacatacccggcggtcaggttacctccgatgactccgtatctttcgataagggcaacacgtgctccttgccgggcggcggctacagccgcacatatcccggcaggacctgcacctgctactattacatcataatattttgtattcattatctgcttgtatatggaccggaaatagtcttaacagtcattgccccgtcagaatctgtgattgtcacaactctatatttgtttcccccatcggtcacacgaactacaatatgtccatcatatccctttactctcgcagcctcttccgccgtaacccggtcgtctactccgctggggcgatcgccttgccagaagttagtgataaacatgtcacacgcagggagtgttgtctccatcgaattcagtatatcggtacggggatgacaatctacccacgaattgacaacaatcgtttgtggattaagtgctttcagagcatccacctgattggtgttggttacaccgtgatggttagctttcaataattccacctgacctactgcttttgcacagggcagttcggcatctttccacgcatgactcgaacgtccgttatactgaaggtcaccaccggcaaagaaatcaaagttgccatacgaaactttcatcacacaactggttatattctccggcggacaattgtcactggaggtaatgttcttactgttttcgtatgaaatctccgagagttcagggaatgtcttctttgtggtagtgcccgaacctgtccagatctctccattcactgccacgttttgcacctttgcagtaggatactttgcaggattatacttctgaacgatctgatcattcgcccctgctttgaatatcgcagcatcgaacttttgattggcgacatgccatttcactgcattgatatagttattacaacttggagcattgtctgccattgtcgccatattgaacggatagttataatcgggatagccacgatcgagaagcgtaccaatcttgaaattgtcgaaaatctcggcaaaacctatcaacgaataagtgtcggagttggaagatttcggcaaggaagaagtataaccgccgaagtggtcattatggaagtgggtaagtacggcataatcaatcgtgctgttacctgtccataccatacacttacgaatgtaatcagttataatctgtgaaccacgggtagaagtcagagtcggatcccaacgactacggataccggtgttggtcgtattactattagagttggtcgtaacactcgaacttgcggcatcgataagcatttgcgtaccatccgggaatattacaaacatgctttcaccggtagtcgtattgatgaaatgaatatccatcacaccctcctgccaggcaggaatcgtcttacctacctctatttcagtggcagcatcttccccacctccatccggacgaatcaaaaatgagtgagactcattggagctgcatcctacaatcgcaaggatgaacagactaaatataaatattaacctttgcatgctatatgaagatttaaaaacatctctccgccttcaatgctgacggcaagacgaatataattaccaaaatttgaatttacctttataatatgttggccaagtcctttgaagattacaggatcactaccgtcgtcagcccaatgtatgccgtcttgcgatagttgtacacgaccttcgaatacgggatctccttctattttctcaaccataacaaagaatatagcctcatctgcccaaccagcctcgtaaggatgagtgaagaaagtacctttaaagaacttctttacctcaagatgggaatcattaaacattttcatatattacattcctccttttattcttgtgaaacaacaacagaatctatataaaagaatacacgacgattggtatcagtacccacccagaaaagaggattgataagattgtcgatgcgtccatatccgtcaacggtatcagctgcaatgccacgcatatcccaaattctgtcctgacattggaactctacatattcacgaagctctgtgtcaagtttcagacgcatgtattgccaattgagtttacagtcggtctcattgtaaatgagtttctgatgaccatctttcaaatccttgaatccatcgtggtcgccattaggataacggcggccgaaccaccagggatcgactcccctcttacaccagtctccgtcaagtccataagcccaatcgcggtcggttatgtcttcattggaatgttcatactgccacttctgcattaatttgccatctactgcattgagataacgaattcctacatggtaacgttttccaccctcctgtacatcgaatcccataccaaaatcgcggatggaactctcatgtaaacccggttgcggacggtcaccgccatccaccacatcctgttccgccgtgtatgtaaaccaacattctatctgcaaatatttgcagcccggacgagagaacgaaagccgcttaatggcatgtcccagacaaccttccgccggaatctccgtataaggagcggcaacaggtcttgtcgaaagtttaagagagtaagtgccggacatagctccgtgagtgcccggatacctgaaagtagcggaactaagcatgaccggtggccactggtctttattgaccaatgtcttgggaacatcaaaatcgggatattccgtaaagttaggcatcaatgtcatccaaccgttaaagccggtgttgaatacatcatagctcaacacccttttcaatggttgatagcgactgcgcaataaaatttctccaatgctcataatatcatttatttaataaagttagtaccctggattttgaacaagtttgccattcattatcaatacatcatcacttggcaatggccacaaataaatcttctcatcatacttacgttcaccatgctggacgatataggttccgtcggccatcgcttcaaaagaaggaaatccgtctttgtcaaatgtcggagtctccggccaaaaccagttgcctgccgcaaagtattcctttgccctgttggctgtacgggtaaatccgtacatattgtgtccgaaagcattctcaaactgatgccaacgaagcaaatcgaaatagcgtagattttcccatgcaaactccacacgacgctcacgacggagcactttgcgcaatgccgtctgatcggttgtcgtgatggacggatagtcgttggtttgtgtacgggtggtgccataagcacgggcacggacatcgttgatgcaagcaatgacagtagcgtcaatctcccccagttcaatcttagcttcggcatacatcaacaatacatcggcataacgcatgagaatgacggggttgtcgttatacaaagtagtacgccatgactcttgcgcgcctttgcgcaggcaacaaccattgtaagcacagttggaagcatccgaaccgcctttggaatctttgtttgtaatcatacgattttgtgtatagtccattacttcgagtgcgtttggcgcagggttccactcaataccatagatacggctgccgggagcagcaaatgtttccaggcaacggggatcacggttggcaaatggatcgtgaggatcaaaaccgctgcccggttcatcaatcgtcttgccattcgtcatttcgtagacagcaagaagttcccacgaaggttgcgcattatgtgtaccgcctgccgaacgggcaataaaggaaccgatagcctgtgtagtaggtttaccgttttcatccaactcaaggtcgcttgagtgagcaacagagaaaataacttctttgcttcctcttgtcttgtcgcggaaaagttcaccataatcaggggccaagtcatatacttccagatccatacagtcttgcgcagcctttgcggcagtcccgtagtcgtgttgatagagagcggtacgcgccttgtaagcataagccgttcctttgtccacacgggtggcgccgctattattatttgcggccggcaaattttctgcggcatagtcataatcttcataaatttgtttcagaacgacagctttgtcggtacgccccatctcaaatgcttcctccggagtaatcgaagtcacgtagaaaggaacatctccccaaagagtaatcaaacgtgaataagcaaatgctctgaaaaaacgggcttcggcacgaagcgtattcagttcagtggtggaatatttgccttcaagtttgtcgagcgcctccaaaatccggttggcacgactaatgttcttatacgtgtaactccaaacagtcttgatgttaggattacttgtagaagacgcattcagtgaacctgccgcaatggtgtaaatgttggttcgttgcgcccagtcatccgtattacggtccagcgtccaaccttcttctataacaaagaaggtactgcgataaaaatcgttcaacgagattcgaacttcctccggtgacgagaaccagttttcgctggatgcagctgaaggaggattcagatcgaggttcacacaagaagttacagatagaagagctatcatgcaaatcaatacatgtatttttttcatattatgtaattttttcatactccattagaatttgatatccactccaaatgtataagtgcgtgtgatataggtagaagcgcctgcttcagggtcccatcccgaaagataactatcaaagcagtatggatcatcgatattgacgtacacccgaagtcccttgattccgactttagagacgatttttttaggaactgtatagccaacgttgatattctttatacgcatataggcactactcttgagccagtagtccgacattttgtagttgttgtattcaccgccctgatgactcaaacggggatagctggctgccgcgttctgctctgcagtattatatacactccaataattacggctgccattgtcgttcagaaggactgacggagccggaagccattgtccctgcatggggcgaatcatactttcggtgaggcgtgaaagttgtttcccgacaccattgaagagtaaggagaaagagagacctttccagcccaaactaatagaacctccatatagatagtgtggcaatgagctgccaagcactacgcggtcgtatgtctcattgataattccgtcaggagtgccgtccggaccgctgacatctacatatttcacatcacccggtttggtagaagccgaaagcagagcgctttcactgacttcctctgcggtctggaataaaccagcagtcttatatccataccaggagttatattctgcgccttcggtaataatggtaccatcgctgttaaactgctgcttgccgttaagattatctattatagacttgtaatcagagatattaaaacttaccgcataatttacatctccgatacggtcagaccagccgagtttcacttcccaaccacgggtatgcattttacctacgttcctgtcaggtgccgaataacctgtaaacgacgggattgccactgacaagagcatatctgttgtcttcttataataatagtctgcgctaaagtcaagacgattgttaaagaaagcggcatccacacctatatcccagctctgtgttttctcccaatggatattctcatacgcataatcctgttgagcggcagacatcgaagattggggcgtagaacctgcactgtcatacataatggcattattgaacgaaatgtatgtctgataaggataatttccaatccgctcgttaccgagcgtaccgatagaggcacggaacttcagatagtttatcggggttatgttttgcatgaacttctcgttagagatgacccaacccaccgatgcggacgggaagaatccccaacggtgatccttgtgaaaacgtgaagatccgtcttcacgagcattgagctggaggtagtaacggctgtcgtaattatacatgacacggccaaaaaatgaacggtatgcattctgataagaattgccggctacggcaagagcattcttgttcgccaaatcaagataagggaaagaagacaaagacatatcgttggtcgatcccgacatcgtttcatacgtataactataatcttcataaccgaccatggcattgaagttatgtaccttgctgaaggtcttgtcgtatgtagcgatgaattgtttctccaatgatttgatgttacggcgttcttcacttagcgaattggaagtatatcctgaaacatatcccagcataacatcggtttcgtatgcatcgtaaacaggtatggctttcttcatctccttgatcgaaacagttccgacggtaggagtcaggttggcagtaagggtcaaatcttttatgggcttatagctcaacgagaatttaccggtcattgtgttggatacggtcttcttctctccgccttccaataaggcggcaagcgtattgctaagactgccgtctttaccaggaccaacacggccatccggataaagtcccaaataaatggaaggatacatataagctgcacgaatcggactaccggaagtcgggtcatttttcgtggcataacgtaccgagaaatcgatagaaccggagagcttatcactaatcttgagattattacgcgaacggatagagattctttcgtggtttgaacctttatagatagcgtcggcattttcgtaggtagcggaagtgtggctcttgattaccttgttgccatacgtcatggtcaagttgtgcttatggcgcatagcagtattcgaaagaatagcgtctttccaatcatagataggatattgaatgggatcatacctgttgttggtagcatagttgtcgatgtagtcctgtgaatagttggcaaactcgcctcccgcaggattaccggcatcgttccacgaccattcgttatacattgtcatgtagtgataagggtcggtcaggaatttcggaaattcggtaggagaagacaacgaaatctctccgttataaccgatcgaaagttgtccctcggttgcctccttagtcgttatcaagataacaccggcagcagcacgggcaccatagatggatgcagaagctgcatctttaagtacagtaatctgctgtacgtcttcgcttgctatattgtcgaggctactgaccatcataccatcgacaaggataagcggactcgaatcagacattgttgtcacaccacgcacctgaaccgtagcacttgcccccggcatactgctcgaacgggtaaccgtcagtcccggaatcagtccttgcaaagattgtgaaagttgagacgtgctctgtttctcgataagcgaactgttgattacaccgaccgcacctgtaagatctttcttttttacagatccatagccgataacaactgtctcttcaagttgtacagcatcctctttaagttttatatttactacactcttaccatcccacaccacagtctcggtcacataaccaagataacggaattctattgtatggcctgattcagcgccattgagcgcatactttcccgacatatcggaggtagtaccttttgcattgtctttatcgtggatcaccactccgacaagaggaccattggcatcgctaacgacacccttcattacattctgtgcaaaagccagattgatttgcaggaaacatgccaataacaggcttaatatactttttttcatactatttattctacgatttcaagcaatacatgttggttatactctttgattgccgcacctgtttcagggttacttggatgttgcgctgaaaaacgtgtctggccgcttgcatgtgtccagtcaatatattttccggcatatctggcaccactaagacataaacggcctgcctgtccgaatcttagcacaatctcatccatatccttagtcgtggtaaatattccttcggcagggatatatgcgccattgttactgctatcgagcaacattcccgcaaagttgtaggtaatagtcgccgagtaattgataggtgcacccgacagtgtctctgtcgcactttcctgaagagtcgaagtcggaagagccggtttccattcttctccatccttgaactcgatcatccagtagttggaacacatcgttcctaatttggtcacaaaatagaagtgtatcttggtaccggcaggaatggtcgtacctttcatatccccatagacataccaataatcacccggaatagctcctgatacatacgggtcaccattagcacccacggcacggctgcatacgactttctgctctacataacctgtccggtcacatgcccaatactcaatcttaccacttccggcactcggagcaatatacttgccattggttcccgggaataccgattgtgcctcatcatcagcaaatgttccacttgtgttggcagttaaactattcaagtcccaatcagccaaaatgcccgagaaagcatcttgtacaagagtataggtatagtctgtatcatcctggatggttaccgttactttaattgtccttttggtaaatgtcttgttctccgggaaagtaagtttaatatcacattcgcctaccccatttgcaggagaaacggtcacatccgcatctgtacacacagccttccactccttatcgccaaagactttgaacgaagattctgttgtagttgcgtcaatcgattcggtgataggactgatacctttcggaacaatcatcttttgggtaataaccagctttagaggagttacatcatcgccaatgaaacgaatggcaccgacacgtgaactagtcgacgaattttcagagactttgattgtaaatttagtaatctcaccttgtgtctcatgcgaatcaacaactgcccaatggctatcgcttccatcggtctgacaatcgttattgactctgtaatagacattagatgaaaggtcaacagtgaaaagtccaccttctgcttctacatcaagtgtctttgtcgcgagtgtcatatacggatcatccgagttatgacaagatgcaaaaagcacaagcgacacacttgcaaacaataacatctttagattcatttgattagtatttagggttattaataattgactagctagacattttcagacgtcttgcatatataattctgtatatcacataagcaagtatcatggcaatcatcagtacgatacttcctatcacaattcctttgaccgcaagagtcttcggatcgccagcaataagcagacctatcagtaagagcgcaacgacaccaatggtaatacagaagcagttaacagccaaatgcgaatagattaataccgcttttttctcctttaatgtcggttcgcgatcggcttcaggatcagtatattcacaaatggcttgataaccattatcttcatactttttacgtgccgaccaaacttccatgattgcaaggataagtacaggaagtacacaaccggcaactgactctataaggcttggactaataacggaggcgggaattatgacgcgagccataataccaacgagccaggtaagaatcattgcagaaataagttggttgcctgtcagccgcttcgagaacagtccccatattgacggaatgtataaaggacacatcaccatagtaagaagagttactaccaccttttcggcacctccggcaaacgggatgagcattgacaaagcgataatcacaagcccaaagacaaatgtgaagagacgtcctaccttgatacgctttttctcatctgcctgacggtttttctctttgtgtccccaaatatcataagtatatacattggcatatacattcaaaatgcccgaaacattactcaatgtagccgataacatcgctgccaacatcataccgaccattcctttcatgagcacgagtttgctcatattcacataagcgtgttcgccgttgaaagtcattgtggttgcatccaaatcaagcgcaagtccaggttccatcacacgataaatcatggtaggaagataccagataagaggagtgacgagataaagaattccgattaaataagtactcttttttgcgtctcttgtagtaggcacgcttatgtatcgctgtacaaacggccagtcaccgccaatcatagacacattgagaaatatccacagtaaaagccacccccatgtataggtcggagatgtgcccgagaagaatcccggtatctcactggccttatcgataaatgcacttacgcctcctaccgcgttaaatgaaagaggtatcataaatacaaccacggccagaagtactccgaactgaattacatcagtcattagtaccgcaagaaatcctccggcaatggtgtatccaagagcgatggcaccaagaataagaagcgcccaccaaatacttaggtaacccatcggtgaatcgcccatcatacccgtacttgcaaaaatactgccaccatcgactttgattaatgcacacatcacaaccgctaccgcatacagagacactgccgtatgtaccgcacgggctataattcctgaaatcgtgtaaaaacttaccgtacggtgtccgaaccggatggtaaggaactcccccggcgatttgatacgtagctcccgccatttgcccgagatccatttaccgacaataaacgatgctacgccaagacaaagtgcaacaactaccgcaacaagtcccgatttataagcaacgcctccccaaacgacaaaggtacttgccgagaagatagtcatgtaggaagagactcccgacagccaccacgaagaatttcgcccggcaacaaacatatcttcggagtttttaattttccgggacatcacaacactcacggcaatcagtccgagaaagtagagtaaaataataatataatctaactgttccatattctggttcttctttatataattgctccaagtttcttcaattcctctatgagattgtgaatatcagccttttgtacggtcacacctgcctttatacattgtgcggctgctactcctgcggcttgtcctacccccatacaacttgcctgaacgcgaagtgacgcaaaggaagtcttatcagcactaatacagcgtcccgctacgagcagattcgggaaatcttcagctataagagcacgataaggtacatacgccgcttttttaaggaaagttacgctctgttccgcacctgctgccacatggatatctataggatgtgcgccgcgtgatatgctatcaggatatttataagcattcacatattcttctgctgtaatggtatgtacacctttgatacgacgtgtctcacgaataccggcatgtacggcgacggtcgtcacataactgtttttaaactcttcaaagttctctttaaagattcgtgctattttaaatacgtcttcccgtaagcgacattccgctgcggtaaaatttctattatcgatggcatttcctgcagtacgggtcatattaaccgttacttcgcccggacgaagagtggtgcaaaaccaaggacctccgaattcggggatgccaagcttctctttcattgctagaagtttctcacgaactgcaatgcaatgacaattctgcccttgtttattatggtgcatggcatcgattatcatgggtgaatctgtatccacaccgcctaatataaaataggtggaaagaggttgcagcggtttacaatcatctgtttgcatcggaacacccgccatagcggcaaggtcaccatccccagtgcagtcgatatacatatcggcacttatggcctctgtcccattcttattctcaaagaggatacaggatattttgccgtcttttgcctggcaaccgcttaagtaagagtgcatatacatatccacgccggcttccagcatcatttgctggcataaaagtttgtaaagctccggatcaaaagctacattgccaagaggtttctcaatgatacagcctcccatcttctccagccgttcgataaattcccatggaataccgcctatcaccttttcattattataggtgaaaacactcaaaggagtaacaagccccattgtagccattccacctaaaaaaccatattgttccacaacagcagttttcgcaccactgcgagcagccgcaatggccgcaatgaaaccagctggtccgccaccgcagacaactacatcgtagttgcccacaattggaacccgtttcgaaatttctatacttcgtactttcttgtccatgaccgttttttatcctttaattattaccaattcaaatagatggtaaactttgatgtgctttcgaccgcacttataagaaaagaggtgtgttttcatagttctttttctttagttcgacatcatgttgatgtagcaaagataaagaacaagagcttgaaaaaaagttttttcctaactcttttgcctgcaaacgattgcgggaacgttcccaaaatctgcaaacgttacaaaagcattacacaaaggcaaatgggattcgtattttactccaatattaggatttattgtttgaaatcaatatctttgctttgatttaaacaatcattcagcatgaagtatataaccataaaagacatcgctcgacatttgtcaatatccgtctccactgtatctcgtgcattgggagatgacaagaatatccgtaaagaaacgaaagaaaaggtgatagaagcagctaaaagattgggatatagaccaaaccctgtagcaatcaaccttaaatacggacataccaataccgtgggggtgatcgttcctgaaatggttacgccgtttgcttcacgagtaataaacggcatacaagaagtgcttcacaccaaaaatataaaggtgattattgcagagtcgggaggagatccggaaaaagaaaaagagaacctgcaactgatggaaggattcatggtggatggcatcatcatctgtctttgcagttataaaaggaataaggaggaatatgctcgtttacagcaagcgggaatgcctatggtgttctatgatcgtattccctatggacttgaagttccgcaagtaatagtggacgattatatgaagtcattctttctcgtagaaagtctgatccgaagcggacgcaaacagattgttcatatacagggaccggacgatatttacaactccatagaacgtgtcagaggatacaaagacgctttggctaaattcgggattccttttgataagaataatatgctgataaaaaccggtatgacttttgaagaagggaaaaaagcagcggatatattagtggaaagaaatattcctttcaatgctattttcgcttttacggaaacattggctattggagctatgaacagattgagggaacttggaaaaaaaatacccgaagaaatcgccgtagccagtttttcaggaactgaactttccaacatagtctatcccaaattgactacagtagaaccgcctttgtaccagatggggaaaaaagctgccgaacttattttagagaaaatcaaagatccggcatctcccaatcattcaatcgtgttggatgcggaaatcaaaatgcgtgcatcgacgccacgtttggaggtatattaatgacttatctaccagatattatatcttaatactttcctgaaaaacataccgaagttacaaaagtttgctgaatagtaatcttttacgataccaacaaaaaagaagaattcagatttatatagttttgaatcattcaatgctctttctctataatacgtccaattcttccagctccttcacttttcttctgtatggccgataaacaagcagtttgtaggtgaatagccgccccttcacctgctcttcatcgtgaatcaaatcaaattgcagcctccagattccaccattgagtaaaattagtaaagctatttcgtaattagtttcaaccttgtttgaaactaaaagtttcaaggcggaaaacactttgtttcaagtagcgaaacgaagtgtttctcggtgtgaaacagattgtttcaagccttgaaactatttttgaaactactcgctacaggtgaagagatggtgaaattgttactcttcacccgcaaactccttattcatcgaagagacagagaaaaggtgaaagaagaaatagaaagattgaaaataaatacccagtagaaaaatttaatcgattttgtaatgattcagaatcgtacaaaaatgaatgacaattcattttcaattactaattcgcattaatttaaaatataccataatattataagcaggctgtatttgcttcctatgcaatactctactttcccctccgttcatagctaatttaggctaaaaagaacattttctcccgaaaagtttttgtaatatcagagttaatcgtatttttgtgtacaattttggtgtagtgatgacagaagaagaaaaaaagttattgaattcctttgaaacgcaactacggcatttgatttatttgcacgatgaacttaagcgtgaaaatgccgagttgaagaagcttctcgaaaatgaaaagctgaaaaacgagaaggtacaagctcaatacgatgaattggaagtcagctatacaaacctaaaaacagctacggcaatcagccttaacggcagcgacgtaaaagagacgaagctgcgattgtcaaaattagtgcgtgaagtcgataaatgcatcgctttgttgaatgaataagaagaagatgtatgaacgataaaataaagataaacctgcagatagcagactcaaactacccgttaaccatcaaccgcgaggaagaacaaatggtacgggaagccgccaagcaggtaaatatcaggcttaataagtatcgggaagtctataaaaatctggaacccgaaaaaattattgccatggtagcctatcagttctcgttagagagactgcaattgatgcaacgtaatgataccagcccctatgtggagaaggtaaaagaactgacagaattgctggaggattattttaaggaagaataaatcccgactggctattcgctgataagagataaaacaaccacgcactgcacaatatccaagcaaaaataattgctttgatatttggcggtgcgtttttatttatatacttaaattaaatgtagaatgatagcaataatagcaacagcaattgcttgcttcatcgtaggaggagtcctttcatatatactattccggtatgtactgaaatccaaatacgataatgtcctgaaagaagcggagacggaagcggaagtaattaagaaaaacaagctgctggaagtgaaggagaaattcctgaataagaaagcagaccttgaaaaggaggtagcattgcggaatcagaagattcagcaagcggaaaacaagttgaagcaacgtgaaatggtacttagccagcgtcaggaagaaatccaacgtaaaaagatggaagccgaagcggtaaaagagaatctggaagcgcaacttgtgattgttgacaagaaaaaagaagaactcgataaactgcaacagcaggaaatcgataaactggaagcaatctccggattgtctgccgaagaggccaaagaacgcctggtagaatcactgaaagaagaagctaaaacgcaggcacaatcattcatcaacgacattatggatgatgctaaattaactgccagcaaagaagccaaacgtatcgttatccagtctatccaacgggtggctacggaaactgccattgaaaactctgttacagtattccatatcgaatcggatgaaatcaagggacgtattatcggacgtgaaggacgtaatatccgtgctctggaagctgctaccggtgttgaaatcgttgtagacgatactccggaagcaatcgttctttctgccttcgacccggttcgccgtgaaattgcccgtttggccctgcatcagcttgtgactgacggacgtatccatccggcccgtatcgaagaggtggtagctaaagtacgcaaacaggtggaagaagaaattatcgaaacgggtaaacgtacgaccatcgacttgggtatccacggtctgcatcctgaattgatccgtatcatcggtaagatgaaatatcgttcttcatacggtcagaacttgttgcagcatgcacgcgaaacagccaatctttgtgctgtgatggcatcagaactgggactgaacccgaagaaagcaaaacgtgcaggtttgctgcatgatattggtaaagtgcctgatgaagaaccagaattgccacacgcattgctgggtatgaaacttgccgagaaatacaaagaaaaaccggatatctgcaacgctatcggtgctcaccatgacgaaacagaaatgaccagtctgctggctcctatcgtacaagtatgtgatgccatctccggtgcacgtccgggggcacgccgcgaaatcgtagaggcttatatcaagcgtctgaacgatctcgaacagctagcaatggcttatccgggtgtaacaaagacgtatgctatccaggcaggacgcgaactccgcgttatcgttggtgcagataagattgacgacaagcagacagaaagcctgtcaggtgaaatcgccaagaagatccaggatgaaatgacttacccgggacaagtgaagattaccgtcatccgtgaaacacgtgcggtaagtttcgctaaataacgtaacgattcaaaagaagattcatataagggcgaagaaattcgcccttttttaatacacgactatgggaaagtatcaatttgagatttgtaccaattcagtggaaagttgcctggccgcacagaaaggtggtgcagaccgtgtggaactgtgtgccggaataccggaaggtggaacaacgccctcctatggtgagatcgccatcgcaagggaagtactgactcatacccgcctgcacgttattatccggcctcgtggaggagattttctgtattcggatatcgaaatccggacaatgctgaaagatattgaaattgcacggaaattaggggcagacggagtggtattcggttgcctgacagcagagggtgaagtagacttgccagcaatgcagaaactaatggaagctgctcaagggctatctgtgacttttcaccgggcatttgatgtatgccgtaacccgcagagagcattggaacagatcatcaaactgggatgtaaccgtattctgacttccggccagcaacctacggctgaacagggaatcccccttttaaaagagttacagaaacaggctgccggaagaatcacattactcgccggatgcggagtaaatgaaaataatatcgcacgcattgccgcagaaaccggaatcaacgagtttcatttctcggcacgtgaaagtattcagagcgaaatgatattcaaaaatgaagccatctccatgggaggtacggtacacatcaatgaatacgaacggaatgtgacttccgtgcgaagagtgaaagagacgatcgaaactttacacaaaagaatataggtgactgtttatctccactatataataagaaatgataatcattcttttccgaaaaaacgcattaagggcaagaattaacgattattgtatacctcctcttttctataacccatgtacaactttcatcaattgctcacccaaaccgattgtatatccttgagaaacaaaaactaccctattaaatgtatctgcaataataaataccggcagaatagaattgttcaaattcatagcctgcactatttctttgcggatgctgtcatcgacatcaataccgtaggtgatggtagacggaagtcctttaaattcgtcggcattaaatttcttgtattgttcttccgaagggaaaagaaagaccatcttacgcccccattgttcgaagtcattgcccaaagcggctatatctcttagcgcatgattggtaggttcctgccctactccaagcacagctactacaaaatagccacgtccacaggtttgcaggatactccgctgttcagtgctgtcaaccggacgataggtcgcttccgaattaaaattgccgatcacttgcacctgatctttgctttcacgcatcacaaggtcaacggtggttgtcttaccgggttctatagtaaaaaatgtactgttggaaagcaccgcgccacttgccaaccgagttccggtcaccatcatataatagccttcatcaagctctctcccatattttaataaattacgccaggtagttccatcccccatatccgtctctccttcgtcataattaagcaactggaatgtgccgtttttaaacttggaaagagtgaaatgcgaataatatttaggatcttccacagaacggataggcgtgtaagtcgcttgtaacactccctttcgagactgtgcagcttctgccgtatcgaagttgacatcttcctttgcaaattcttcatttagaatctgcacctttccggtcacttcatcaatccaggcagcggacgcccatcccatgctccggtaagctgccacaaaaaatatatcacgcgacttttcatcagccacccgtgctttccatactcccatcggagagataggaatctgttgggaattcagttcattattgattttaatctcttttctgcaccattctattaatactttgggatcacgtttcatgctatcgggcacagactggtacactgttttttcaatggcttcacgaagtacctttttataaggagtcaacatttcattagctatacgaggaggattgaggtacattcttttaaataaatcagtctctatcttctcccaatccgagatattagtcagcagatgatcattcaatacatccagagttacatcgcggagatctttagccgaaagactctctaatatccatatagcccgtatttcttcccatgaaacagcgtctttctcttttcggatagctgaaaggaagtctttcaaggtttggtggtttcctcgcgaagcaaccaggaagtttaccagtttttctttcttttccggttgtaaggtatttccatatagttgatctatccactctttggcctgtttttccgtcatcattgttgctacatacgcattgcggattgaatcttcctgcgccatccgccgatcattttccgcccgttgttcgggagtgacttcgggaatattcgctccttccaccggaggtacaagatccattggcaaggaataggcttcaccttctttcctatttaaagagagttgcaatgcatcatcttttccaaatgagattttggcataaccaaattgtccgttgcgggatgcccaaaccaacatatctcctttaccggcagtcaggctggctttcccctctgcatctgtatatttcgtggctactgtataaaactccgcataattgtatatcttaaattcgactttggcatctgctaccggttgaccgtcggcatccgtcaccgttacgatagctttggcagtaggggcataattatcaatcacattgatttctgtataattcggcgtctcaagcataatctcttccggaccgttgtaacgtccgaaaaccttggtatgcatcaacattccccgactggcaggggaattaaaccatcccaggttcaaaaccggttccggttcacaagctccaaagaagtaccaatgtccatccgcccatgcttccacccaagcatggttatcatccgtatgcgcccagcggggcgtatacacttgccgtgccggaataccgactgcccggagcgcagccaccgtaaatgtagactcttcgccacaacgtccatacgctgttttgacagatgccaatggtgagctggtgcgcgcatcactcggacgatagaccactttctcgtgacaccagtggttcacctctaatatcgcgtctttcatcggcagccccttcaccctgtcttttagttcaccataaaacacacgacgggaatcatccagattctcgttattcacccggatcggcagaacaaaatgacggaacacttcatcgggaatctctttgccccaaggcatctcgtcacgtgtctgcttcgacagccggacattctccaagtaataatctcccggatagtccgtcacatcccctatcggcatataagcgtagagaaacatcaatgcttcgcgctcgtacactgacagagcggaatcaccaaagatcgcaaataaatctccatgaggaagtgcctgttttttctgctcaaagtcttgagctacttgattccggtaggattcttctttgaggaagtgagcattgttacaagcaaacagtacaatcgacaaaatcaggacgcacaaaagatgggtgaatgttttcatataagtgtttggtttattctattaataaggttgctgactgacaaaaatagaagaatattttctgaatacctagataagtacataaaaatgtgatagataagaataatattgtcattgatgggaaaatccgggaattttgtaacaggtttgtaatatagaccgtgttcgaacccttataaaaagaaaattcaaaagaaaaagaagatttttatgttttacagcatataattcgaaaacaatttgtatctttgcagtgttattagagaaaacaagatgtaaaaccgctcttcaaaacgtggagggcaaaaaaagaggaaacaaattatgaaaaagaatgcaaatgaaaaaattatgatgttacagtaccgtattaaacgctatcaagcaatgggaaatggtgccatgtgccaaacattaaacggtaaacttcaaaaactgctgtcacagcaggttgccatgtaaataaacacactaattataataaatagagcgaggaactttcgagtatcttcgctttttttatacatttgcagaagaaagataataaaacacattatgaaaaagctatttatgtcggttgcgctcctcttattggtcgtaacctcttttgcacaaacacctggttatgagttcacaaccattgtatctcaccaagcaacgcctgttaaagatcagggttccacaggaacctgctggtgctttgccaccgcttctttcatggagtcggaactgctccgaatgggaaaaggagaatatgatctctcggaaatgtttatcgtccgccaaaagtacatgaatcagatggaggacaattatctccgtcgtggtaaaggaagtatcggtgaaggaagtttggcacacactttcaaaaacgcttataagaaagcgggaatcgttccggaagaagtgtacaccggattgctaggcgataacaaagaccacaatcacggtgcattgtcacgctacctcaaagcattggtagacgcaaatattgaatctaaaaagcgcactccgcaatttgatgcgcttattaataatctgtttgatatttatctaggcaagcttcctgaaaaattcacttataaaggaaaagaatatactcctcaatctttcacagaaagtctgggattgaatatggatgattacgttgagttgactagtttcactcacaagccttattatgagacattctcacctgaagttcccgacaactgggaaaaccagccaatgtataatcttccgttggacgaactgatcgaggctatcgactatgcactgaacaaaggatataccgtatgttgggacggtgacgtaagcgaacagggtttctctttcaagaacggaatcgccatcaatccgcaagtggaggatgtgaaagattactcgactaccgaccgtgcccgttttgagaaaatgccaaaatatcaacgaatggacgaagtgttcaagtttgagcatccttatccggaaatcaacgtaacaccggaaatccgtcaggatggttacgagaagtttgtgacaactgacgaccacttgatgcacatcaccggcattgtaaaagatcagaatggtactaaatattatatcaccaagaattcctggggagcggaaagcaacaaatccggaggttatctgaatatgtctgaaagctatgtacgtgctaaaacaatctgcgtgatggtacacaaagattctctgcctaaggaactgaagaagaaactcggtattcaataaatcgcatgaaatcagtcccgaagggagattgactgtttcatacatttatttattcggaactctccattatattcatataacaaaaaaaatagggcaacgaagtatcactacttcactgccctatttttttgttaacctactatattaaatcctttgctctttatttctttttcaatgtcacgtcgctgatttctacaacgccgcctttattctgggaaagaatagccacataacaatctttcagaatagcagcatcatcgtctgtatcagacacttccaagttagcatttgctttcttgctgctaatagcatttaccacttgccccatatcataataaaccactactttagtccatttaccggcatctttaattttaaaattgtactgtgcgcccgaagcatttggttgagcatccgcgtcatagtctctacgcatgaagaaagtagtattgtacttactattatcattcttttcctcattggtctgtttgatgtatacactgaccggagttcctgcttctttagcctttgcatagaaagtaagaacatagatacctttgtccaaaccatcggtaatacgttgtcccaggaaagctttataccaagagagattcttttcggcaccggagttatccaatttcattgcattcggatatttggcatctcctgtttcttcccaggcaatagtagttactccgtcagcttcattattcatgataaaccactctcctgcggtagctttgttggcattagtcactttagtctttacttcagtggcgaatttttcgttttttatcaggttctgcgcacttacgcttactcctgcaaggaccaaaaacccggcaaataatacttttttcatcttactgtgatttaattgtttatactttattttttctagctttaaaaatctatttcatcctacttcacttgttgaataacaaatccatatttaccagtcactttcttttcttcagtctttagtgtgatgcggtaaatctcttttccccatacgttagacaggcgcgaatcatccagtttaattgtttccagttcggctttaaactgcaacggatagttcatttccaccttttgtccctttacttcgatgcggatttttccggctgaagggaaagtcacattgccccaggttaaaaagttcatttgattaggaacaatagcctcatccaacgtataaatatcaccaataataagttttttatcatcaagagcataagagcgaacccagcttttcactttcgcttctgccggataagcagtagctatatccgtagagaacatccgtttcttctcattgcaaacggtattggtagctttatactcctgcccgaatttctgcggtactccgttaatcatcggcaagttatgatagttgctctgcatcgtccaaatggtatagcggtccttgccgaacgtctgtttggtatatgtacctacaccggcatcaataatcacaggaattgtatttacatataaagaaaaggttcctacatcgttgtggttatggctttcgttattaaatccgcctttagcggcaacaaacataccgtttttgttcttcatatagcagaattccgtctcgggataccaggttacatccggcatatcatgtttcggagttgcttttgccagctcattacagcaaagtagagattgaagcgaacgaaaagcgtcgttgcccatggtagcatacggttttcttcctttcaacaggtatgcggcaaaatgcatcatttcatcgctgtttacagctttaccgaagcgatagattaacaaaggatcgcccccgccttgtgccgatgcatcagcaaaattcaccacccagccattgcccacgtatgagcgggacatatattctcccatccggcgaatcatcggttcattgaacagagacagtttaccgcctgtgccatcagagagtatctgcaaatagtcatagagctttccggcggcatgtccccagtaagaggttccctcctcacaggcaccatcggatttcacgaagttgataaacttatcgactgactgcatggagcgataaacagctttcgccaacttatccttattgttctccatcagtaagaaacattgcagggcattggagttacaccagggattccagttattgatgatttctcccggtttccagttaaaagccatccaccacatttcgtcgtcgttcatatacggatcgagaatacgttctttaattgctttacgcatttgcaaggataccacaggattgattttgtcgaatggtttacggaagaaatagtgtacccaggccattaaagctccgtatccgcctgaaccgaggtcgataatctgttcgcggaagtcgggaagtgaacgtttgctgctctggcggggcaagtgtgcggatagaacccatgaattcatttcacagctcatatatgctccgttcagtagttggtcgataaaacgtcctttcccttcggccagttcggcgagcatcaaggcgttaagtgcttggcggttggcgtcataaggaacttccattattttacggttaccgctacgttcgtattccagataagcggtggcaggtatcagttgccatttatagtcgaggagtttttcaccggcttcgatgaggcgttgcttattggggcccatcaaagaatcccaggcggcacgatctgtataagcaggataaggcacccatgcttgtttcattaccaacacgttttttaacgtagtttcgtctgccgctttttgcagcatattgcgttcggtgtaagcgtttgccttgaaagaaaaacttcctaaagctgctagtaaaagaacacaaaataaatgtttcattcgattcatggtattttcattcatttaagtattgcaaagataacgtatctgataaaaaatgaggtgagtaaatcatacgaacctgatgacaaaaaagtacatacttcaaaaatagtactcttaattgctatattttaggcttttaagtcattataagaacaaattaagtcattgtagaaacaaatcaagtcactataaaaacaaattaagtcacacggaaaccgggttttcatttcggaaaaacaaagatgcagttttagaaaacagaggcttcctttggagaaaatagaggttctatttattccaaacagaggctctgtttaggtcaaataaaggctctattttatttcaaatagagtatctgttttacttcagacaaagtatctgtttggatattctatcctctttctttttttcattctttgattctcttctttttcatcccttattctttcctcttcatccctctatttcttccccttcgccttcaatcccaatcgctaaattcaaagctcaactgttcccaaacaccgtgttgttcatcggcttcctcttttggattggagacggaaagaccgatgagccggattggatgttgctcaaattcgacgcttttaagcaattcttttgcaagtgggagtacccggtctaaggtggtgagttcctgcgattgagtaaggcttcgggttatctggctaaaatcatgaaacttgattttcagagtaagcgtgttgcctttgaagtcttttcgctgaagacgttcaatcagctctactgctacatggtatagttcgataatgaccgatgaacgggctgaaatatcacgttccaatgtacgttcgcagccaatggatttacggatacgaattgcttcgacagggcgttcgtcaattcctcgtgagcactcataatacagtgcgccggctttcccgaaatgggctgtcagcatttcaagagagcatttccgtagttgaagtccattgtggatgccaagtaaatgcatcttctttgcagtcaccggacccactccccaaaaagattcgataggaagacgggcgataaaatcaagggcctgttccggatgaatggtacataagccgtccggtttgcgatagtccgaagctattttagccagaaacttgttataagaaactccggcagacgcaacaaggttgagctgctcccgaatcttctgctttatttcctttgctatatccacagccagggaaatatctttcttattttcagtgacatccagaaaagcttcatccagagacagaggttcgatgatatccgtatattcgtggaaaatctcatgtatctgacgggaaacggatttataaacatccatcctgccaggtacaaaaatgagttggggacaaagtcgcttcgccttttgcgaagccatagcggaacggacaccgtaacgccgggcttcatagctggcagcagccacaactcccctctcttctgcatgacctaccgctaaaggcttgccacgaagttctggattatcacgctgctctacagaggcatagaaggcatccatgtcaatatgtataatctttctctgcgtcattgtttgggattagcagagcaaacttactataaattcccgaataaatcctgcttatcggttcaagaaataatatgcttatgatttttatagatataagtcaaaaaaaacattcaatatctcgtcaaagacagttcttataatattatatttgcatatcgtctattcaaaatatagaggtagttaataagtttgtgccatcatacaactctttaagattatgaaaaacacattattttgcttattcatattttgcagtgtttccacattcgctcaaaatggaatcacttttaaggtcgaaaagctttcaaagcctgaagaattacttcatatacactccccgaatgaaatttacgaaagtcttatattatcagatatgaacatagagccttatgagataaaagagaagaatatcaaggttccttatcatatcattgcaaagagcgaatctcccgacagtctcgtttcttttggccctaattcttttttcaatggtatgtatcaggcttatgcggatcacaggccattcgtattgtctccggacatgatttggctattaatcagccagggatttgcacggcatatcaatgccaatcaggaatctatgagaaatgaacttgttgatttctccggcaaactatccttaattgtaagagaagacaaaaagctggaagaccctactctttcgtgggagaaaatctttccgcaatttacagaacaaatatcccaatacgccggtaagcatctgaccgaactgctcacctgcaatttttcaacgactacctctttagagaaagttgcttccgaaataacaatcatggaagctgtaaaaccttactttgagtttatcatcatacgcattgtctgtggaatacctgaaataactctcgaaggaacaccggaggactgggaaaaactactgcacaaagccagagggttgaaagaatacaaactcgattggtggatttcagaactggaacctcttttggaagaatttgtcaaagcatctaaaggagaagtcaataaggacttttggcgcaacatgtttaaatatcattcacagaaacgatacggagccccaaacattattgatggatggatcgtgaagtttttcccttatgataaggaagggaaaagaaataatctgaaacagctggaaggcaaaaattgtctccctgatgagatagtgaaggtagatgtaaagtatcaggaagtatatggcgacgctatcaaagaaactccattagaattttgggcaggtttcattggattagagcaaaacagcaagacttttgctctgcgaccgcaaattggttggatggtcaggaagaaagacgttaataaggagggattaaaaagtaaattaagtgctgatgctcaaaaggatggttggggaagcggcatcaatatcagagtaaaagaatttccggctgtactgttggagctcaaagaaataaaaaggttggatatccaatttatcgatacaatcaatataccggacgaaatatcaaagataaaaatcggatcgttgagtttatatggaaagattactaaagaagggatagaacgtatcaaaagattattacctgacacagatataaaaataaatggttcgcgaggtgggagtgcttcatttatgactccataataaaaagaggctatccaaaagccataagtcagatttcaaaggctatcaagatgcactatcccgaaaagaaaggatattcagcgagaagccttacctatatgtgtcagtttgcccgaacatacccactagagatattacaaagaatgctttcttgtgacaaggtattgggaacgccaacaatccccaatatgctatccttgactgatgaactgaactgtttaccaattacgcaagaacctcttgcgcaatttcagacaaatatatttcaatcaaaagaatttacgcaagagcctcttgcgcaaattcaaaagatagacaagacaatctccgcaatgctgcaaacatccattgatgatattgaaaaggattttgtttgttcccccatttcaaaaataaactggaccagtcatgtgatactattggatagctcattacccttaggaaacaaatattggtacatgaaacagtccgttgaaaacggatggagcagcaacgtattaaagatacagattgagactaatctgttcaaacggcagatagaaacacagaaagtcaacaactttacaaagaccttgcccgctcctcaaagtgacttagccaactatttgctgaaagacccgtatatattcgatgtagcaggtacaaaagaactggcagatgaaagagatattgaaaaacagcttgtagaacacgtcacaaggtatctattggaaatggggaacggcttcgcctttgtagccaaacagaaacatttccaagtcggggatagcgatttttatgcagaccttatcctatactccataaaactccacgcctatatagtcgtagaattaaaggctactccattcaagccagaatatgcagggcaattgaatttctacattaacatcgtagacgaccagttgagaggtgaaaacgacaacaagacaataggattgttgctctgcaaaggcaaggatgaagtagtagcacaatatgccttgacgggctatgcacagcccataggagtaagcgactaccagctaagcaaagccattcccgaaaatctgaaatccgccttgccaagtatcgaggaagtggaggaagaattatcacagctactcgataacaagaaagacgaaaagtaatccgatcagtcccgtttggacagtcttgacatttaagccgtctgccacctatacaacgaccgattcgacccgagcattgacgaacagataaatatcacagaaaatagaaatattaaataaaacaaaagcaccccgctttacattattaggatgtaaagcggggtgcaaatctcataaattacttaaaatcagcatttattgtggagctggagggaatcgaaccctcgtccaaacgaggaaatcataagctttctacatgcttatctttgcctaaattttcgtgcaggaacagaaccaaagccatcaattcctgccttatcctctaaagcttcatcaaaagtgcgaggccgcctttgactatccccgatgtaactgcaccactgaaccggaatgcttcggagcaacagcttccgagtgatgtctcgtcctggcacctagtgcctggattaagctaatctactgtgattcgattaagcagcaagagcgtaattagtttcgccagataaaattttggtaactgatatttaagtggaaattaccgacccactgcatgcttacctaccatttctgcccgctgtcaaatccagtcaaccccaaatttttattcgtacagaatagcgattgtttagaacgctttccaagagtgcaaagataggaaatgttttctaatttacgagaagacgttagcaaatattatatcaaagcactatctttacggagctattttatatttaaggtgaaaaagcatcatgaaaaatcaaccaataataagctacttatgattaagacatatctatctaaaacatctatattcaaagcatttgccgctgtttgcatattcggaatcagtatcagtggctgtacttctaaaaaaaagactcctatggaaacaaccgatacaacggaaaacgaactaaccatgttggtgggtacttacacatcaggaaccagtaaagggatatatagctaccgcttcaacgaagaagatgggactgccactccgttaagtgaaacggaagttgaaaatccttcttatcttgtttcatctgccgacggaaaattcgtctatgcagtcagtgaattcaataatacacaagctgccgccaatgcatttgccttcaataaagaaaaaggtactttgcaactattaaattcacagcaaacgggaggtgaagatccctgttatatcatcgccagtggaaataatgtgataaccgccaactacagtggcggcagcatctccgttttccctatcgcaaaagatggctcgctcctacccgcttccgatattatacaattcaaaggtacgggagtagacaaggaacgacaagagaaaccgcatctgcattgtgtccgtatcactccggatggtaaatacttgtttgccgatgacttgggtacagatcaaatacataagtttatcattaacccagctgcaaatgcagaaaataaggaagcatttctgaaagaaggatcgcctgctgcctttaaagtgaaagccggttcgggtccccgccatctgactttctcgccaaacggtcattacgcctatctgattaatgagttatcgggcacagtaatcgcttttgaatataaagacggagatttaaaagagatccagacaatcgctgccgatacggtaaacgcacaaggaagtgctgacattcatatcagcccggatggaaaattcctgtatgccagcaatcgtttgaaagcagatggtattgccatattcagtattcacccggataacggaatgttggcgaaagcaggctaccaactgacagggattcatccacgcaatttcatcatcacgcctaatgggaaatacttgttggttgcttgcagagatagcaatgtgatacaagtttatgaaagagatgcagatacaggactattaacagacgtacatcaggatattaaagtagacaagccggtctgcataaaatttgtgccataatttgtcataatcccctggctattcatcaactactgatagccctttactttttattttgagcaatccgattgtcaggaatttgagtcttcacaacgattttactcccgttcttggtacacttgatacattctttccgcaatgttctctcttttaagtcaaaaatgagattcggattaaaatgttgcccgttaatacgggtttcgaagtgtacatgttcggtagtggcacgaccggtacgtcctgtcagcccgatagcttgtccggcttttacaacatcaccagttttaaccagattcttgaaattgtggctataaagcgtttccaatccgttagcgtggcggattacaacgatatttccgtaggcataatagggtttcgacatacgcaccactccatcaaaagcagcacgaatcgtatcttttgcacaggtcttaatgtctgttcccgaatgtcctccgcgagttccataggcagagattacttttcctccgggtaatggaaaagcatattcgtggtctttcagagaatccaaatgcagatagatatgattgcttttagcaaataatccgggagtagctacccgtacatcagccatttcgcgggcagagaaggaggatttatcctgcccgtcggcagtcagtggcaataataataaaactgtcagtaagataagtatgtttttcatgtcttttttcttagagcactcattctaattattcgaagaatgcgatttcgcctccatccgattctgtatagtttcttaataaggtctgtatcatttcaacagcttcttgcaaaccttcttttccgttataaccattgactatggctaggatatgagtagttccgaggtccatcttcgtacgttcatggtcgcttgtcggggttccgattcctccgaaagaatcgcgatatacaggtaatccttcgatattcaatacaccgcgtccgataccttcaaacggttctcctgctttgccgataccgagttcaaggtgcgtaccttgtattttgtccgcgtcaaaaccaccgatcgaatgtcctgtgcgaagagacacaaggttgataaggtctaccaacgtatcaatctgatataaaggaattccacgcatcaggcggcggcgtagagcttcggctgacgggcggtaacgtccggggtctttgccacaacgtttataagcctcacgggtagcaaagataacgggttgatgtttgatgtcttccatctgtgttgtggaagtcagttgcctagtaaaagcgtcgatctcctgccaaagcccttcgctgtaagctgtatttttcactgcagcatacacggcggctccggcaaaaaccgggcatgcgtcttttatttctttagatacttttatttcaaacataacttatcataaaccaatcatcagcgtcctgcgattacggacaccaattattactttctaatcattattcccgacaatgtacgaccggaatctattcccagtctacgtgcagagaagaattcatcatgatgaatataggtacagattccggccacttctatctgttctgcaggcactccgagattcagtaattcaatccggttagcttcccacaaatcaatatgatatttgcctgtttctttctttttcatagaaataagagacatatcgaagccgctttcttcaaaagcatcatacacctcatcacctacttcaaatgattcgagcgaaatgctcggcccgatgcaagctatcacatcttcgccttgcgtcccgaacatcttattcaagtggtccatcacattactgacaatatgcttcaccgttcccttccatccggcatgaacggcagccacaacgtgttgttttttgtcgtacagcaatacaggaacacaatccgccgtcgtgacacaaacgcaatatcccggcacattagttatcaaggcatccattcctcgcagaagtagccgtctcatttccaatgattctttaaaaaatgattcattgataatcagactggcacagccatgattctgttcaggaataaataattcctttatctgatgattcatgcactgaaacaaccagctctgattacgattgacgttcatgcatgagtcgttggtataaggcgaacagttgaaagagctgtaagctccggtgcttataccttcgtgacgcgtagttacaaaatgagctacttcgggatatgcctccagtgacttatatcccttcaactcgttatattttgtaagtgaaatcatttttcttcccaatcttcttcttcgtattcataatcgatatcatcgtcatcgtcgacatcttcctcatattcataaacgatgtcttcatcttcgcccatgtctttgagttcctgttgcagacgggtcacgtctttcggacggtgaacgatgtcctctatcttattgctttccttgttcagttcttcccaaaggatgtctttcaacaccgagatgcccaaaccggaaacagaagatatgaatacatgtggaatgccttccggcaatgtaggttcaatctcgtccatcaactcctgatcgagcatatcgctcttggtgacagccaacacacgttgcttgtccaacatttcaggattgaaggtacgcagttcgttcagcaagacttcgtattctttacgaatgtcgtcgctgtctgccggaaccataaacagcagtaatgaattacgttcgatatgacgcaagaaacgcagtcccaaacctttcccctggctggcaccttcgataatacccggtatgtccgccatcacaaaggattttccaccgtgataggaaacgatgcccaagttgggttcgagcgtagtaaacgggtaatcggcaattttcggtttggcagccgaaatggaagaaagcaaagttgactttcccgcattcggtaaacctaccagaccgacatcggcaagcagtttcagctccatgataacggtcatttcctgcatcggctctcccggctgcgcaaaacgcggagcctgacgggtggccgtcttgaaatgccagttaccctgaccgccgcggccgcctttgagcaagaccacttcctgtccgtcttctgttacgtcacaaagatactcccctgtctcggcattataaactaccgttccgcagggtacttctattattttatccgcaccgtcttttccgaaactacgtcctttgctccccgattcaccatgaccggccattgcatgacggtcatacttcaagtgcagcaatgtccagtaattacggttaccgcgcaagatgatatgacctcctcttccaccatcgcccccatcaggacctccgttaggacaatatttctcgcgcctcatgtgcgtagagcctcttccgcccttgcccgagcgacagtatatctttacgtaatcaacaaaattcgattcagccatatttttttaaagagttaaagtagtcagtagttagagcagttaattaaaacactccggctactgacttatttatttataatatcgtattattacaatttatctactgcttcgcagatttcagcgaagataccttccatagtacccaagccgttgatgtgttggtatttcttttcgttcttgtaccagtcgatcagtggagcagtctgtgaatgatatacatgcagacgtttcttgattgtttcttcgttatcatcagcacgaccggaatccttgccacgtttaatgagacgtaccatcagttcttcttccggaacatccaagtcaaccattacagaaacgtcctgtcctctttctgccaacattttctttaatgcttctgcttgtgcaattgttcttgggaaaccgtcgaaaattacccctttgctatctttgaagctgtcgaatacgcttgccagaatatcaatcattaattcatcaggaatcaattgaccttggtcgatataacctttagctgttttacccagttctgtgccattcttgatttcagcacgcaatacatctcctgtcgagatgtgattgattccatacttttctacgatacgttcgctctgtgttccttttcctgaacccggagcaccgaaaattacgatgttcaacattttgttatttacaatttaacgatttactatttaccatttaaactggtacctatttaatattaatctactactgtataaatatcgggataattacgtccgaaaccatcataatcctgtccgtaacctacgataaagtcgttcgggatttccatcgctacatattcaatgttgaggtttaccttgagcttttcaggttttaccaacagagaagcgatatgaatagcttcaggattgcgtgtacctaatgtttcgagcagtcgctgcatcgtcagtcctgtgtctacgatatcttccacgatcacaatggtacgtccggcaatgtcttcattcaggccgattacctctttaatcactccggtggaagtgatgccctgataagacgccaacttcacaaatgagatttcacaagggatggtgatgtgcttcagtaaatcagcggtaaacatgaacgaaccgttcaacacactaaggaaaagcggattcttacctgccaaatcgcggttgatttcgttcgctacgcgaatcacttctttctgaatttcttgttccttaatggaaacggtaaacaatttgtcttttatctgaatggtatccataaccggtaatttaaaaataaccttgcaaaaatacgattttttattctaccccgtgcatcatcttctgtaatttcttcgagagaaggaacagaatcaacgaagcaacaccggacatcacgacgaataccataaagaaatcatacatggtagcaatctgataaccaaagattgacttcacttttccggcttccggatagagcccgctcaacattcccgcaaatttattggctgtggcagtagacagataccagattcccatcatcagggaggcgaaacgcagcggactcaatttatttaccattgaaagtccgataggcgacaaagctatttcacccatggtatgaataaagtaaagtcctgtcaaccaaatcatgctcactttcactccgggaactgcatctttcactccgaaacagatgaaaagataacctaaagaaaggagtaacagaccaatcgcttgtttggtaggagaagcaggttccatctttcgcttgttcaggaaaccccatacacccggcatgatatatgccaggacaactacaaacagtggattgaaggattgaaaccatgaagccggcatttcccaaccgaaaatgtcacgattcgtctgttcggacgcaaagagagttaaagaagctcccgcctgttcgtaggctgcccagaagaagatgacaaagaaggctactatatagataacgaaaatacggctgcgttctatttttgtcaatgaaccgtctaacaagatcagaacagggaaaacaatgcaggcggtaaaaataccgatactcacccaatcgccttcaaatgcatagttaaagaaggctattaaagcaatggtaagaattgtgattacaagggtattacgtactttggtacgtttgtccatcttcgggtgtgagatatggtcggccttgtcttctttcttttcacgtttagcatcggggataataccaatcggttctccggaaggagaaaaaagatatttattcttttgagtctcgaaaagaacaacggtgaacagtgtcatgattccggctgcaagaaatccccatttaaagtcatgcggatcaccggtatcacccagataaccacaaatcaaaggagcagcaaaagagcctacattcactcccatataaaaaatggtgtatgcagcatccaaccgcctgtctccgggttcgtagagctgacctaccagagaagagacagtgggtttgaagcaaccattgcccaagatcaggaagcctagtccgccatacatcatccagtgggcaaggtttgtattatctaaagtggaggcactcataaacatcaggaattgcccgactgccatcatcaccgctccccaaaacacggaacgacggattccccaatatttatcggcaatgtatccgccaatcaacggggttaaataaactagtccggtatagctgccgtagatggatgctgccgcttctttgtcaaacaataatgcctgcgtcaggaaaagaataaagatcgcacgcataccgtaataactgaaacgttctgccgtgcttgtcgcgaaaatcagataaaggcctttcggatgccctttcaatgcactcatgaatttatgtgtttagtagtttatggggtgcaaaggtacagaaaaagtagattagatgcttctcttatcaaacagaataatagggggaatagtaaaaacgagcataaaaaatcctactgatccacttcattacttttttagcagtgtaaataataaagtggagatccatcttaaatgtaggttagctaccaccttagccaaaagtaaattcgacattttcgatactggcaaaaagcattccttctcttttcctcaaaaagattttgtcttctcgggccagccaaccaatagcaagagctacgtcttcaaacgtcaaacttaattcacggcacaaatcgaacattgaaagttcacctttttcatttaagatgcgccatactttcccggcattcaagccaatttttgtcttttccatcatgcaaactttagaagattaaacaatccgttatttagattttaattcattttcattgtgagcactggaaaataatgtgatgcacattatctatctccaaagataacatttttatcggaaacggcaaataatcaaaggcttaataaggggaaccgcattaaaaatttgtttaagaaggtatggcgataaactaaacacaatttccatccgcgcctctacagaaaaagatttttcatttctcatattctcataaataagaaacaagtggcagtaaactaataagatagactatgagaaatgatttaaaaacaggcatttctcatagtttcttcgcaaaataacccggattttgcttcatttctcatagtgtagtgtgccggaagctgacattgaataaataaaactatgtattccttttgcttgcttccatacacagtgtcttagttccacatattgtgggaaaagattccctaaggcttgggaaagtattcccttattttgtgggaaagtattcctgtatattgaaggaaaactttcccacaatatatgggacaatcgagaccaatgagcatcttcaagcaaaaagccactattttatctaaatagtagcttcatttcctgataaaaataaggcaggctgaaagaaaaaaggaagaacaaatggcttttgactatgagaaataccctgaaatactatgagaataaggtggcttttgagccaaaatatgggagaacttatgagaaataccgtttcgaaaaagtgtttctcataagatatctatttgattagctttcgtttatcgaaaaacaatgagaatatgagaaatgaaatgaagaaatctttttcaggagaaataaaagtaagttcataatggtgctgcattgaattattttttggcggagttattctaacacttaatagttcaaaaacagatatttctctgaccaaaagatagaactaatgatgaattaaaagttgcaattatggttttcttcccacaacaaacgggaaaagtcagaagaatcatgtacatttgtaatccgaaaactaaaagaacatcgcaatgaaaatatttccaagcagcagtatcaagaaattggacgcttataccattgagaacgaacctattgcatcaatcgatctgatggaacgtgcagcaaccgtattaacaaaagccatcacagacagatggaatacggaaacgccggtcactatctttgccggaccggggaataatggcggagacgctctcgccgtagcccgcatgatggctgaaaaaggatataaaatcgaggtatttctcttcaacacgaaaggagaactttcacccgactgccagaccaataaagaactggtagaaatgatggaagaagtaaaattccacgagatcagtacccaattcgtacctcccgccctgacgcccgaccatctggtaatcgacggattattcggttcaggcctgaacaaaccgttgagcggcggattcgctgccgtagtaaaatacatcaattcctcccctactatggtagtagccatcgacattccttccggactgatgggagaagaaaatacattcaacgtaaaagctaatattatccgtgccgacgtaactttcagtctgcaactgccgaagctcgcctttcttttcgcagagaacacggaatttgtcggagaatgggaagtgctggacatccaattaagcgaagacggtattgaagagatggaaacgaactacgaaatgttggaaatagagcaaatccgttcactcatcaagccacgcaaacagtttgcccacaaggggaacttcggccatgcactattgattgccggttcaaaaggaatggcaggagcctctgttcttgctgcccgcgcctgcctccgttcgggagtagggttactgactgtccatgcgccaatgtgcaacaacgacatcttgcaaacctccatacccgaagcaatcgtagaaaccgacatcaacgaaacctgttttgccgtacctaccgacacggacgactatcaagcagtcggcatcggtccgggactgggacgaaacgaggaaacggaagctgccttgttggaacaactggaacactgccagactcctgttgtggtggatgccgacgcacttaatatccttgccaaccaccgccatgcccttacccacctgccgaagggttccatcctcaccccgcatccgaaagaactggaacgtctgaccggcaaatgccaggactcttacgaacgtctgatgaaggcttgcgaactggcccgtgccgcccatgttcacattattttaaaaggagcctactccgccatcatcacccccgaaggtaaatgtttcttcaacccaaccggaaatccgggaatggcaaccggaggtagcggtgacgtactgaccggagtaatcctggcactacttgcccaaggttacccaaccgaggaagccgcaaaaatcggcacttacattcacggactggcgggcgatgtcgctcaaaagaagcaaggaatgatcggaatgatcgcaagcgatattatcacctgtctgccgacagcatggcgacttgtaagcgaataaaagttaagaagttacccttttttcaataacttcattaactttgttttcaaaaccagttaaaaagaaccgaatatgaaaaagttgattatagcagcaggactacttatgacaacgtccgcctatgcacaaaccgaagtactgacaggggttacccgaggaaaagactatggagtggtttacagtcttcccaaaacccaaatagaacttgaaataaaagccaacaaagtcaactatactcccggagaattcagcaaatatgctgatcgttacctgcgactgaccaacgtctccgccgaccctgaagagtactgggaactggctagcgtaaaagtgaaatccgtaggtgtgcccaacagcgaaactacgtatttcgtaaaattgaaggataagacagtagcaccgctcatggaactgacagaggatggcattgtgaaaacgatcaatgttccttacagcaatagcagtgcaggcaaaaaagttgctcccgcccccgcagtcctccaaaagaaagcgaatcctcgcgaattcctgaccgaagagattctgatggctagctctaccgctaagatggccgagctggtggctaaagaaatctataatatccgcgaaagcaaaaatgccttattgcgcggacaagctgataatatgccttcagatggggcacagcttaaaattatgctcgacaatctgaatgcacaggaagaagccatgacgcaaatgttctccggcacctgcaacaaagaagagagaacattcactgtccgccttacccctgacaaggaattcaacaatgaagttgctttccgcttctcgaagaagttaggtgtagttgccaacaatgatttggcaggaactccgttttatatcagtctgaaagacctgaaatcggtcaagataccacaggaagacgataagaagaagaaagatttggatggaatcgcctacaacgtacccggacaagctatggttacactgactgacggtaaaaagaaactttacgaaggtgagcttcctattactcaatttggtgtgatagaatatctggctccggttttgttcaacaagaattctaccatcaaagtttattttgatccgaatacgggaggattgctcaaagtggacagagaagaagggaaatagaaaaatgaggaagtgaacttctaaaaaacaaagaatatggttggtgaaggacatgcattcgacatgatacgccgaataaaagagggacgggaagcttcccgcctacgtcgtgaacgtgctaacgataagttgaagcatttaaaccgtgcaaacgaaccttatccactacccaacaccacccccgaagaaatggaacgtatcatccacgactcggagaaaaagaaagagaaagacagcaattattttgtttggggaacgcttattatcatgggggtcctgatagcaattgccgtcatactttgggctgtatttatcaaataaataataataagttcctatttatacgactggtatcaccagttttataagtccatctttctgcatttgagaaagataagccgatacacgcgactcgtagccctcttcattttgaaagtggtctgcgagtttttctataatctcacgaacattgcgttttccatctatcagttcccatacagccgtaccgtgttcttccaatttcacatgaagttctttcgacattcctttcggcacaaggaagcgttgcatccacggatatttaaaacggggaaaggagagcacaattgtctccccttccctttctgctgtaatatgttcactgcgacagggaatgacctctaacaggttgattttctctttggcagccatacttcttattttttatttcagagtatttatactgatactcttctgtttacaccttgatacaaaattcctttgtcactttaggtattgaatttcctagttacttttggatattcgcctcttccagaccgtatcccttcttcttgttctctgccttcaacatcaaagccacaatcagagcaagcacaccaaagagagcaaaaatagccatcggcaacgtgtagtcataagtctgtgcaccgtctactaccggacctttgcaataagtattcaacacccatccgatcaacaaaggaacacccatcaatccccagttctgtacccagaaaatcaatgcgtatgcagtacccaactgtttttccggaataatcttcggaacagacggccacatagctgaaggcaccaacgagaaggcaaatcccaatataatcatgataatagtagcaaaccaccatatattcagtataggcagagcaaacatcgtatgcacaaaaataagcatcactgatccgattatcatcaatgtggctcccttaccgatacggtcataaagcgagccgaacaacggagtcaggataatcgcaccaatcggcaacaatccgggaatcgttcccgccaacttcggatctacattatacttctgcaccatcaagtcggcagcatacttgataaaggggaatacagccgagtagaacaatacacatagtaatgcaatcagccagaatcctttattggtaatgatatacacaatatctttcatacggaacggctcttccggttccaatccctctgcatccaaagaagcatccaacttcttatcatagaaagtataaaggaagaaagcaatcgtacccacgcacaacataatcagacaaaacaaaatcggagcaggaatattggtatggaatgtgccactctcatccgtagatccgaaaaagtcggccaaaggaaccgtaagcaccattgccagagttgttccgatacgtgccgtagccatttcaagtcccatagctaatgccatttccttacccttgaaccatttcacgataatcttggaaactgtgataccggcaatttccacacctacaccgaagatagcataccccaatgcggccagggttacctgtgttttgaatccaaagagcatggcaccttccggaaaagtagtagaaatcgcatagtatttcaatccacaaccaaacaccatcaataagcaagctcccattccggtgaaacgaactcccatcttatccaaaatgataccaccgaagatcagcatcaataggaatacattaaaccatccgtaagcgcttgtgaagaaaccataatccagactgtcccatagtagttctttctcaagcatgggttttagaggagacattacgtcggtgaggaaatagccgcatagcatagtaaatgcgactaatgctagaacactccatcggagtacggcggagtcattcaatttttgtttcaaatgttctgtcattgttatatttaaaaatagtagttaataatcttcatacgaccaacaaaggtagttaaatctcgtttgtttctatcacaaagagattgtttttacaagaaaaagttaagtgcggattacactgaccacgcggaagattgaaaatccgtgtaatctgcgtaatccgcacttaaatatcaaagaaatgcagcatccgtctgcaccttcccattaatggttttaccccaaagtcttacctgacgacagagtgaattactctgctgcaggagcaggagtttcagcagccggtgccggagtttctgtagcaggtgcattggtagcaggagcttcagtttgcggcgcagccgtacctgcgggtaagttatacgggttagtctgttgttctttctgtgcctgttccaacactgcgtctttagcaacagcagagcgaggaactacataagcagtagcaatgctcattaccaccatgaagatagctaagccccatgttgctttttccagaaaatctgtagtcttgcgcacgcccatgatggcgttagatgaagagaaaccagaagcaagtccgcctccttttgagttctgaatcagcacgatgaaacacatcaacaaggctgcaataaccattaagataacgaataataagtacatttttagttattttgaattagcgttaataatcaatttctccaaaaatctgatttggtctgcaaagtaagcatttttttttggatatttcaagcttaattttttaattatttcaagagcttttgaatatcgttgctgtttaacatagatttttgccaaagtttccgtaaaacagctgtcatcttcctcttcttccttcatcgtttcttcttcggtaagttcgtccgaagaggttggcgaagatggcatttcttctcttaaaggtttcatgcagaggggagagtcgctctcgctcttttctataaagtcgtcaatcagttcgaagcctttgagtttgggcgtttcttcggccggctgttccgtggctggagtctcctccaaaagataagaagtgtaatccatcgaatagtcgaaactggtccgggcagtcacctcttcgggtactgtggacaagaaagcgtcgatcaatgctaatgtgcggtctacggacggttcgtctttcagcacctccgtaagaggtattccctttttccgtgcctgcacatcatagcggtcaccttcaatcaaccggaacaactgccgtctgtctgcaatgtaaagaactgctttccgcagttctccaccgaaactaatatcatggagaatatacagattcttcagatacagcagacgaagtgactgaaaatacggatacctcgcaagaagattgcgcagttcgtacaaagtatccctattcagcgtctcgggatgctgaatccattgttgaaagttaacagaagtcatttatattaccagtttgctacagttgcattaaaaatttggtcggtgatctctttagacatttcagcaatcaatccgtcctgtacggcagtcaacaactgggtagagtcgtaggtacggaacgcagaaaactgttgttcaaagtcttcggcatgattggtgttgttgacaaaacgcacattgacggtgatagtcaacttcgtctccgaagaataaccgtcggcagatactgcctggttgtactgattgtaccctgtgatttctccgtcaatctgcaagtcggcattttgactcggcttgagcagttgcagacgggtctgccggatgaagatatctttcaggtcctcattgaatttggttgccaacggagcatatacatactccgacttgatcgggaagtcggctatcgaaatggtctttaccttatcataattgatagacgatccgttaaacttataggaaacagtgcacgcaatgactaccaacggcaagccgaacagtagcaaagggcgtattattttcttaatccaattcatattcttttatttttctataaagtgtacgctcggaaatattcaagtccttggccgcactcttccgctttccgtgatgcctttcaagtgctttgcgtatcatttctttttccacttcgtccagtgacaaaggaggttcttctacatattcttccgtgtcttgtatgtcgtcatcatccttgcaaaccgcaggctgcatggtatgaatgatcgcaggtaccgaaggctggtgtgtcgtcactaccggagtagtaaccaccgttcccacttgtcctacctgtcccacctgtccggcacgttccgccatcaggttgtgcaccatcttcttcagctccgccacttcctggcgcatatcgaacagaacagaataaagaatctcccgttcgctctcaaagcctttactctcacgcgttcccatcagcgcgggaagacgttgcgtattttgtgcgggaagataattctgcaagatagcagcagagatctccctgttggtttcaatgatagatatttgctcggtgatgttcttcaactgacgcacgtttccgggccacgggtaagccaataactctttcttcgcatcctccgtcaactggatagcaggcatccggtatttctctgcaaagtctgcggaaaacttacggaacaacaaaagtacatcgtcaccacgttcacgcaaaggcggtatttggataggcaccgtattcaaccggtaatataaatcttcacggaaacgtccttctgcaatcgcttgtgtcagattgacattggtagctgccacaatacgaacatccgtcttttgcactttggacgaacctacttttataaactcgccactctccaacacacggagcaaacgcgcctgggtaggcatcggcaactcccctacttcatctaggaaaatagtaccaccgtcggcttcgccaaagtaccctttccgttcgccaatcgcaccggtaaacgcacccttctcatgcccgaacagttcggaatcaatcgtgccctccggaatagcaccacagttgacagcaatatactgtccgtgcttcctccggctatattgatgaataatctgcggaaaactttcttttccgactccactttctccggtaatcagcacagacaaatcggtaggagctacctgaatggcaacatctatggcgcgcgacaatgcttcagtatttccaataataccgaaacgttgtttcacttgttgtatctctgctctcgtcatcactcgtttttaatcttcgtctactgtatccagcttcagtttatcactatcgtcacgtttctcgtaatactgtttacgcaacggattggcacgagccactttttcccgctgacgattacggaacacatcgatggcaacatagattgcctgacggaaagaatcttcacaagccaatcccttgcctgcaatatcgtatgccgttccatgagccggagaagtacgtactaccggcaggcctgccgtatagttcaccccgtcttccatagccaaggccttgaacggagccagcccctgatcgtgatacatcgccaggataccgtcaaaatgagtataattgcctgaacccataaagccgtcggccgcataagggccgtagcaaaggattcctttctcttccatttctttcatggcagggataatcacttcctgctcttccattcccaacaaaccaccgtctccggcatgaggattgagagagagcaccgcaatacgcggagcgccgataccgaaatcctgtttcaggcaacgatggaatatcatcagtttctcctgaatcagttctttggtaatcgtagtcgcgatctctctaacagggatatgtgtcgtcaccaaagccacccggaagtcattcttcatcaaaatcatcaatgacttatcaccattgcccagacgttcttcgatatattccgtatgtccggggaaggagaactcttccgactgaatcgtatgtttgttgatcggagctgttacgataacatctatcagcccttcgcgatattcttcgatggcacgttccaaagcccccagcgcagctttaccggcttcgggatcgggtttggaaaattccactttcacctcatcatccgtacagttcaccacgctcaaacggttgtaccccgcttcggtagcagagttgacaatgctgaaattggtctgtatatccagcgctttgcgatgataagccgctactttcggtgagccataaatgatcggagtacatagttccaacatcgtagggtcggaaaatgtcttaagaatcacctcatagcccaccccattaatatctccttgggtgatacctatccttatcttgttatcttccatgtttttatttattagtttgttccgcttccttagatgcttctcccaatggaatctgattctgctgaacttcattcggaagtttcagtgtatacagagatgcttccatctggcgtaccaggttgcgtttcattttatcaggtgaataaacaaatatttctgctgttataattcgttggtttttctcgtccagacgagtatgagatacatacgggccacccataaagtcgcccttcatacgccacaggccacgtgcttccattgtgtagctgttctgtacattgatcggacggacatcggtcagcaaactatcggtcgacatataaacgccttccttgaatccggggatattggctttcatcacggagtcacgtttgtgcacaaaatattctttggtaaacgtatccttgtcagtgtacggataagagtacatcacaaagttacggtcagcactacctgtgttggtagaagcccaaaagaaatcatccccggtctttgaattagccagttcggcatccacccagatgtcgcatccgaacaaactgtccactttctgcgaaatgaaattactgtgtttcccttccaggaacgtaatctgacgattcatctccgcacgggtaaagaagtcgacaatcgtctttttgttctcttccacaaacttctcaaactcttcttcgttcggagcctggatagtcaatatcatctgcggattggcatacacgtccttcgcatatttgaacgaggctttcgtatatatatcctgtatatctacaataataatgttacgtatcaacttcagcgtagaatcataatctttcggcgaagtatacataatccggaaagaaggttccgactgcggcaaaccgggcatatcagcatcgagcgcatcatgtaaagcccttccggcagcacgatcccaaacaccgtgatctactacaaccaaaagctcgtaagcacgaccactagaggtgtgatttcctttcagaccacaagatgcaacgacaaaggctaccaaagcgatgcataaaataaaagagtactttttcatgatgttcggttttatatattaactttcattatttttctcctgtttcgctgtcgacagcataccgcaagcggcaaaaatatcttcgcctctggatgaacggatagtggtgaaaagtccgtgtgacgtcagataatcacgaaaacgggtcatcgtatccatatccgccccctcaaggtctacccccggtatggcatgaaaacgaatcagattcaccctgcaatccagcccgcgaagaagtttcagcaactctttggcatagacctgcgaatcattgagccctttaaaaacaatatattcaaacgaaagtcgacgttgtttactaaaatcatagttttttaacagttccaccatttcggtgattgaaaacgccttttccgccggcattaattcagcacgctgaacggtcagcggagagtgaaggctgatggcaaggtggcagtcattttcttcgataaaatgctgcaatcccttccgtagcccgacagtagaaagcgtgatacgcttcggactccatgcgtaaccgtaggtagcggtcagtagttccaatgctttcaatacctcatccaggttatcgagcggctcgcccattcccatcattacgacattagtcagtttatcccgttccggcagcgaatgaatctggtttatgatctggctggcggtcaggttagcggtatacccctgtttgccggtcatacagaacttacagttcatcttgcagcccacttgtgacgacacgcacaacgttgcccggtcatcatccggtatataaaccgactctacaaaatggttctcacccactttataaagatacttcaccgtaccatctacagagcgcatttcatctaccggagcttccgctcccacctcatagttctgcttgagcaactcccggtgtttcaatgacaaattagtcatatcatcaatcgaggctaccttcttttcgtaaagccaggatgcaatctgcttggcagcaaagccgggcatacccagtctttttgtcaatgattgaagctctacaagagtcattcctaaaaggggatatttagacattcttctttctgttgatagtttatatctgcaaatgtaaggaaataaagtcgatttccgtatagcaggaatgtaaaagttaacaaaaaagggaagtatgcctccgttatgattcaaccacgctgatatattgaagtagcttttgcgccatttcagaatcctcgccattctttttcacttcatgaccgtacgcctcacggaaacaagccagcgcctcttcccgttcattacaaaagctatgcaaaacccctaagttctgacaagccagaatcgtatcttcttcctcccatcccaaatacttctttcgcagttcaagctctctgaagaaagcctctttcgccattggataattctccaacttcacataagcctgtgctttgtaataatataccagacaggaagcattagggtcagcatcatcatgaatatccaaagacgttgcaatacgaatcacgttatcatagtctttattcatgtaatactgctgcataatatcacatctcaatgcctcgtatcggacagtcagttccgccagacgcggtttttcgctgaaatacatttcatgcagaagagactcacggaagaataaagtagacgcctgctcatcgccacgttcattcatcatccgtttgaattccctgcacagataatacaactgtttatgacaagcgacgatctgttttttgctatctatctgtatagcaatgtccaacgcctgattcatcagcatccatgcttcatcgtatcgtttgatataataaagacatttaccctgcatacgcaaacatttagccactccaccggacagtctgccattcaacgactcgtgcatttcagctactttccggaatttctcggcagcactctcttcctcatccttatagtaatcacaataagccagatattcggaaagttcaatgacttctgcctgactcttctcatcagcagaagccgcatgataatcaagcgccctattcaaatagatcgccgcttcattgtattgctcattgtagtaatatgccagagctagatttcggcaggtattggcaatctccagttccggagtcggcacaatgttttcctgcatcaccaatgctttcaggaaacagtcgcatgccgtttcgtactcttcattacgggcatagcggcatccctcattcatcttcaataccgacttggcaatgagtggcatggcagcaccttccatactcttctcactcacagcagctgccgccttcgtcagatggaaagaactgctcaagaaagtagccatatcattagcaatgacaggaattaaaaaagaatcgatctcatcaaagtccaattcggcatagacttcaggcgtaacttcaggattgtcgttcatgatcgccttccagctatcttccaacagagaacgattcgtgcgatacaaaatctcgaaaatctccacatcacaaatccaatccttcaatatatcccattcttgcatcttatagcattgataggtaatctccactttatagcgatacgaatcatggtagcagaactgtttcatgcgatagttataatcggcaaaagtcaacggatgggaaagaatctcttcctcatccagcaaggcggaaataatttcatggcgactatcatctatacattcgtcatcttgagcgaaatagcgttcgattgcctctaccatttgtgtgtcaccaatgcaatatcgtcctcctttgttggtgagccagctgctcatttccactctcaactgcgaccaaagtatctgattaatgtctgccatgctcttcacttcatcttcggtaaatccttctaaagtaagtgaaagcatcagaagcgttcttccaatctcttcgaaaccataatcagccgacaaacgccgtaacacactgtcatagaattgcccaacctcattaagccggcaatatccactcatatattcattgagagcatcgtactgaccgaacgaaaccagctcgttgagcaatacacttaaacagcgcggttgtttagccagcacccacgaagcaagaatatcttcctgttgtacggacaaagccttggagtaagtagacaaatattgctttgagaacgacttggcatccgcctgtgaaaagccattcaactggaaatgagcgtagtcattctgaacaaagggcaggtaggcagtggatgacgcagaaaagctcaacacgactttcacgttcgggggaatagatgcaaataaagaaaacagggatgcttcagtaggattcagataactgatgtcatcaatcagcagaatgatagggtatcttgatgcacccagcgcactccacaactgactgaacttttggatagaattcaaatcttcttcaatctccttgaggtttcgaagtgtgttccctgaaaaagtgttcaagccagcatctcccatcaaaaccgagtttttcacggcgtccatgatggatttggcagtgctttgggtcgagtccagttcttttgaaacttccgccgcgaacaaattttcttcacccaaagattgatgcttgagtgtgttctggcatttggaagctaacattctcgccaacgtttccggataagaagacaatgtagtactatccaagcgatgatagataggaatcatcggcatatcattgttcaccaaatcgctccaatgagccaacaaagcactcttgccaagaccgcaaccgcccgttaccaccaggcaccgctgttcatccgccgccaaaaaatcagcaaacgcctgatctgcttcaggtattggatgataattgaataagagttcattgcgcgtcagctgttcttgcaatgcttgattatcttcaacggtcagtacatccggaaactcccgttcaagcaattctgtgaaagcagcttccacaaggttacacaactgatcgggcgaatcatactcctgcacaggataacgttcctgctgcaaaatactctttttcagacgtttcagtttaagagcctcctcttcagggcaagacagttcatcatctgccgactgttttatataaaaataggcatgtaacggattgggattgcgcagtacaccaaactgcatttcaatttccgtcacactcaaatggtgattcaaatcatcttctatccaacgatattccaggctgtcattgagagtttgagataaatcttcataactaggacaccatccatagcggtcgcctaccataccaatgaagaaaggccgggagttaacgatctctttcaggcatatttcaacaaccttgccgcttttcgcatcttcttctgtgattccccaacgcaaatcaaccaatgaaatggtggcaccacggctggcagccttcacttgcaaacccttaaagagtttgactaatgcagaacgttccatctccatgtctctgaacgttgacgaaaggaaaacacggataacacgtgaattttcagcgggaactgaatactgggctagttgtttagtcataatatagattcgtattagttaatgaagtatttcgcaaagccaattgataaagattggcaagatatggaaatttaatcagataacaaagaccataaacaaaaaaacgaccacaaaaaaggcacggattacacgggtttcgcggttccctcaaaagtttaaaccgcgtaaatccgtgtaatccgtgcctaatatctattacttgctacttgtttagaagaacaagaagcgtgtatcttttacgtttgctttcagatacaaatcattcatcagacggctggcaaaacgtgcgtgcatgttagtcagcgtagcttcttctgcttttgcgtcgaatgtttcgttcagtttgtccttgccgtatacctgcaatacaaatactccggcattacctttgataggagcgctcaactgattcacttcagctgcagaagcataagcacctaccagcggttcgctgctgcgcaatgctgatacgtatgcaggagctgcaaaagtaaccatcttcaaagagtcgctgactgcattagtcatctctttgtactggttgaatgaagttgcattggcagctttcatgtcagccataatcttttcagctttcttatcttttacgatttcagctctcaactgatcctgtactgctttcaacggacgatatccttccggcttaatgcctaccagacctactaccatcatgtgatcgctttcgccacattcgtacaagccggaaacatcacccggttttgctttatcaaacgcccatctcaacgcttcttttgtacctcttacaccaccgatattgtgttcagagctactcaaatccattctgtcgagcagtctgtaaccggcttcttcagcgttagctaccatcttttctacactcggattagctgcgataaactggctgaaatcattataagcacggttgtaagtttctttgctgaactctacttcacgtttgataacagctactttatatttgtcttttacagatttcttgttagtcacctgaagaattacgtttgcttgtcccatcggcaagttcaccagttcgttcacacctgcattgttgatagcagagatgaatttcaggttatcgccgtctatctgtgcaccttcatactgtgcagaagttagccagtttgcatcaccagtctgaccatatttctttgccagatcagcaaagttagcaccacccttgatcgcgttgtagatactgtcagccaatgtctttgtcttcacagcatcttctgcgtatacctgaatctgacggaattcgacagagtcggcagcagcagctttagctacaattttgaaagagttgattgtattgtcggcaccgttatagtaaggcccataaatagtacctaccgaagcagagtccaaacgggcaactacatctgacgggaaagctgttttgttatagaacaagtctacataaggagcttccgagccagtcgagcggatgaaagaagtataatcttccgtagtagtagccaactgttcagtagcttcgtccacttctttctggatagcagctctgtcttcagcacttgcagtcacttgtacatcaatgtacttgatgtcacgagtttcctgatattgcttgaattgttctttcttcttgttatacaagtctttcagttccgattctttcactacgattgtagagtccactacagaagagtaaggaataccagccatcaacacattgtactggttcactcttgcgtcgaaagcgtcctgtgcttccaccggattggaaagaagagctttagataccaatgcctgatacttttctgccagacggctctcgatcaaagttttctgaatgaaagaccagtatttatacatgttattgtattgttcagcatactgtgccggcatttgtgattcgctcatcttggcatattccacgaggaacttgttcaacatatccttgtcgaagtttcctgtttgcggattctggaaaggagtttgtctcaacaaaggatgaacgcctgctttcaggatgtcctggatttcagcagcagaaacagtcagtcccagtgcttttgcttctttttcgatcagtttattgtttacgtaggaacgccatacttcatcgcgcacctgattggtttgttcgtcattcaaggcggtcaccccacgcatgagtttcaccacttcggtatattcttctaccaaattctgatactcttgagcggaaagagcgtctccgttcacctcacctacgtcatgtgcctgatgcggctgcatcaccttccatgcgtcacccgcaatgaaagcaaacagcgccaagccgataacaatcaccaatagaggtcctttcgacctaatgttttgtaacgttgccattttgattaatacgatttatgtttattattatttctttcttttgtcgttttagcgcacgaagatacaaaaaatgctaatatgcatctatttattggctaaaaatttcttgattatcgtcattattccaagacttttaatcgcacgagttctatttttgtcgctgtgaccttaattatcttgaattgataacgtcctacccggaccacttcatgcaacttcgggaagctctgatattggttcaggatcaaccctcctactgtcagataatcatccgactcgggcaagtcgagtccgtacgtctcattgactttttctatctccaggcgggcggacaacacatactcgcgttcgtcgatttgcttgctgatataggaagtgttatcgtgttcgtcttctatatctccaaagatttcttcaacgaggtcttccagagacacgatgccggacgtaccgccaaattcatccaccactacggcaatcgttttcttttgctgcatgaagagtttcatcagtttatgggcggacatggtttcgggcacaatcggcacttgtttcacattctcatgccagtttttcggggcacggaacatttccgacgaatggatatagccgactacgttatcgatattcccgtcatacacgattatcttggagattccagattctatgaagcggcttttcagctcgtccagcgaggtagtcagatcgacagccaccacttcggtacggggaacgatgcagtcgcggatttttatgttcgagaagtcgagggcgttctggaagattttcacttccgtgtccaactcttcttcattttcggcattatcaatgctgctttgtacgaaatagtccaggtcgacttttccaaaagctctgtcggacgcatccttattaaccttcattccaaagaggcgaaggaagatacaagacaagccggaggctaatttggagatgggatagagaatcacataacaaacaataagcggaatggcaaaaacattcaagaccagattgggattgattttgaagattgttttcggcaaaaactctccggtcaccaggataatcagggtagaaataacggtctgcgccaacaccatcaggaaatgattgtcaatgaatcccgccagcagattgtcgccgataatctgtgccatcaggataccatagatgactagtgcgatattattccccaccagcatggtagagataaattcattcgggttcttgaagaagatagaaaggatgcgggacgtaatcccccccttgcgttccatctcaaaacgcagtttgtctaccgacacaaaggcaatctccactcctgaaaagaaagcggaaaagaccatggtgataattagagagatataaatattcataagttttgatttacgatcagacgatttacgagatacggtacaatgatatgacttcgcctatttcgcagtatctttattcactgaatccggcagtgcttttgtttccggttggggcggaccgctactcgcttcctcgtccacatagaaaataccttcaatattacgaatggtatatatagtcatttgctggttcgagtcgaagccgtgtcctgtgataattctgtccggttgctggatacgtataaacttgtcggaatacactttttgagtggcctcattccagtagagcagttcggtattaaaacgctctcctttgcgattctgtatatccacattccctatcagcttccaaagcctttctttgtcataataataggcagtatctgctttaatactggcttctacattaaagatagagtcgaactgctccatatacacacctttttcaaacgcccaatacgaaggctttttacggtcgtacatcatccactcttccgtgttcaccctataacgtgtcactccggaatcggaaataagggtagtaactcccaatgtggtcatcaccggaagagaatcacgttctgtgatagcctctcccatagctttctgttttccgccacaggaagataataaaagaagcataacaaccaccccgaaggtgattgttatgctcatgcttttatgcaacaaacggtttcttcgttttcgcaacatacggttatctaatcgttgtagtctctcctatccaaccgccgatagtgatgcggtcgccttgcttgtaacctaacataaacaggtctttagcttgtggagtatgaccagaatatctaccgatcaagctattagcttcttcagctacgctcggatctacttgttttgcacgttgcagtttgtcgattactgcaaagtaagtacacttgttcaaagctgactcgtcgctccagttagggctcattgcatacagattggcaatcaggatatatggagcaccatagttttcgttgaacccgatagctttctggcaatatgctcttgcttgagacagttttttagcagaagccaatactgctgcggcagcgtatgctttttcagctttcttcacgttgtcagtttccaatccaatagcttcgtcgaagaatttgacagcaccgtcgatgtcacctttcttaaatgcttggtaagcacatccggtagcggcatctgcactaggttctatcttgtacacatagaaagcagcctgttgataagcttcgctttccgtacatctcatcattttcatgatgtcgattactttcttcaagtaagccaggtctgtttggttagcttctactttcggtccatagatgttttgcagtgattcgcaatcagctgttccgctgtttacaaacaaagcaaccaaattatctttgataccttgcaagtttttcttctttgcttcgttcgtttcagcagcaatagcagcatcagcatattcagaagcagccagataatcctgaatgaattgttccttatggttaggatctgttttcagtttatccaaagacatttgcaggaaatagaagatagtagcggcagcagattcagcttttactgcatttaccgactggctcaaccattgataagcctgattaacatcaattttcggagcgaaagcgatgtaatctactgctttgatacccagagcttcatcagcagaagacacttttgtacctttagccaagaactcatctgtgtatttgatacgcaaatcatgcgtattcatcagttcatcaaaatatttctgatattccggattattcctatccttgatttgtcccatcaagcctttcagaattttatatccgtcagtaaaagtatagaaacgaagcgtcgggcagttttccaacacagctttccaaggagtatacgcatctttaaagttacctgcacgcacagcttcatgcgagatactactgttcgagttacagttagtcgcatcctgtgctaccacagtggttgcccctgccgaaaggaacaacatagccacaagcgttttaattttcattgtatctaaattttagttgttattattatagtcgtctattctttctcttcttacattcatctcaattactctactctgcgtttgaagaaccaacgttcgttgaacgtcaatccgatgctaacgcggaagatattttcgtttacaaaggtcgattcctgtccacttacacgaacaaactgtccgctgatgctaaggatggaacgggaacgaggcacaggcaaaccgaaaccggctgttacgccatattcgcgggctgcgtctttaccgccaatcttataatacggagtcgtataataagctcccaaacgatatttgatgtgggataaataggaacgtccaatcaaattgggaatatattccgcacccactgatattttatgacggtcgcaatacgtgtatgtttcatcaaaatcttcacgtacagcaccatccgatgtatttacgccaaacttagcttttgaccactgctgcaaactataatccaggccgacagtcaaacgtttgtcatagttatatgtaaagccgacgccaaaagtattaggcacttcaagcgtagcatcccaatcctgactgacagttgagctagcttgcgtcgttactgtataatcattattcagtttatgcttcggagaatatactgctccgatagtggctgaatgttttttgttaaattcttgcgtatattgcaatccaaaatccagtttataatccgacactgacacagcattctgcctaatgtaagaataagcagaagcggtattcggataaagctgcgtcaacgagcgggttatatctccccaaaaataagaagcattcacaccaacagacaggtttttcaagacttttacacccgcaccaacatacagttgatgtaaacctccctcaccagtaaggcttttcgtgctatacggtgaagtttctgtagcctcattgctttccgatacagaatatcccacattggagaacggcaacagaccgatactcatcgctaccctcggatgcaaacgaaattgcatagccagatagtcgaagctagagtttttagcgttcagtttcacaccaccgccactaatattcatattttgcagactaacgcctccttcaaaaataaacgtcaacgagtcaatggctgtatacgaagcaggattcagcggattgatctgtgctccatcccgaagtccaaaagcaattccccccatcgccttgctattcccgaaactctgatcggacaagtcgccatagccatatcgtgtataaggagagtttgtattattttgagcgattgccattccggtaaccatcgtgagcaaaagcgcacaaagtgtgtgtttaaatcctaccattattatagtttaaaattctatttaatcctttcaacactaaaaatctatctgcaaagatgatactttttacgctgctatcaaaagaaaaatcatctccgcccgttaaaaaaaccaaaagttcaggatatttatgcttcatagactcaatataacctgaaatttcgtattccatccctttcatcactccggcgcgtatagccgtttcggtgtcccgtcccatcgggagtttgcgcccgttggtgtctaccagaggcaaacgtcccgtaaactgatgcagtgccttgaaacgcatctgcataccgggagaaatattaccgccatgatactggccttttgagtcgataaactcgtaagtaatgcaagttcccgcatcaatcaccaatatatcccgatgaggaaactgctcattagcacccactacggcagccatacgatcatatcccaatgtttcgggagtttcgtacaggttgacaaccggaagcggagtctgatgattgagccagagcaaaggaaacggcaaagcggccaaatcagctaataccttttcgtttagatcaatgacagtagccacgatcccctgttcaaccggatattgagaacaaagagctttcaagcaacctagagactgattggattcagctactacatccacgatttctccgccgtcgaagaaagcaatctttgcctttgtatttcctatgtcgattattaaattcaaatcttttggttctttagcgggcgcaaaggtaaagtaaaaaaagaaaagttgaagcatagaagaggaattatcttcttttttcattttagaaatccccccaaacaaaaaatcgaactatctatttttaaatagatcaattatcttttattgtttattatgtattccactttgcgttcggcagtcctttttcattacatcataaacaactaataagcaatagattacaagagaaaaacagcgttccacaaagcgtttcactattttgtaatcaattttccgttccaacagaaacattatttcacccaaacagaggcttcgttttatcttatctaaaggcaaatttcctgaatcatcttcattttttcattcacaaaacacagaaaaagtgtgttgagcgaactatattatatagattattatattttagtatttatatatgttcggttggtggttcgcctactttttttcgagcgttgcaaacgcatgacagacaagcagttgagccaccttcagggggtgttcgtttggctgttcgattttttagtcccaaaatagaggctctatttgagggaaacagagcctctgtttaagccatatagagcctctgtttgtatgaaatagagactctattccgataaaacagaaccaccgttttcccgaatccaacaattcttcctatatttgccaccaaaataaaacgagcctgctaatgaaacggtttttcttatatacaatcctctccttcttcctgttgcttccgtccgccggacaagcacctgccaacagcaacgactccatccgcttgagtttgttgacttgcgctcccggagaagaaatatattccctgttcggacacactgccatccgctatgaaaacccgtcacaagggattgacattgtgttcaattacggattattcagtttcaacactcctaacttcatcttccgcttctcgctcggagaaaccgactaccaactgggagtgacggattatgagcattttgcggctgaatacgcattctacggacgcagcgtgtggcagcaaacactgaacctgactgatgaagagaaaacaaaactaatccagttattacaagaaaattatcgcccggaaaaccgggtgtaccgctataatttcttttacgacaattgcgccacccgtccccgggacaagatagaagaaagcattgcaggaaaggtggtttatccgacggaaccgcaggatggttcgcgcactttccgcgacatcgtacatcaatattgcaaaggacatccgtgggcgcgtttcggtatcgacctctgcatcggaagcgaagccgatcagcccatcacacaacggcaaatgatgtttgctcccttctatctgatggatgccttcgacggcgcacagattttcacagatacctattcccgtccgcttgtcaagaccaacgaactgataatcgacgtcactcccgaaccggatgaaagcggctggatgcccactcctctccaatgctcgttactattatttatactgacagccgccgccacgatctatggcatccgccgaagaaccggattatgggagatcgaccttgttctttttggcatggcaggtatcgtgggatgcgtcctcgccttcctcgccctcttctcccaacacccggcagtcagctccaatttcctgttattggttttccatccggggcaacttcttttccttccctacatcgtatattgtgtccgaaaagggaagaaatgctggtacttgaccttgaatctggtcgttttaacactttttatagtgctttttcctgtaattccgcaaagatttgactttgctgttgtacctttggcactcgttttgctgatacgttcagcaagcaatctgattgtgacatctaaaaagaaataatgaaaggactactaacttccctcatcaccgtactgactttcaccgggctacaagcccagtcactgccttccgcccctaaattagtggtagggctgactatcgaccaactgcgtacggactatctggaagcattttcgtcactctacggcgagaaaggcttcaaacgtctttggaaagagggaagagtgttccataatgccgaatataccttctgcaacgtagaccgcgcttctgccatcgcagccatttacagcggcacgacgccttccatgaacggaatcatctcccaacgatggatggacgcctctacccttcgccctgtcaacagcacagacgacacggcattcatgggatattacaccgaccaaacggccgcccccaccaaattactgacttccaccattgccgacgagcttaaaatagcgacccaaggcaaaggactcgtatatgccatcgcccccgattgcgatgccgcgcttttcgcagccggacatgccggaaacggtgctttctggctcaatcccaacaccggaaaatggagcggaacgacctattatggagaatttccgtggtgggcaagccaatacaatgaccggcaggcgattgatttccgtattgcgggtatgacatgggaaccggtattcccccgtggcatgtacacttttctgccagattggcgggatatactcttcaaatataaatttgatgacgaccgtaacaataagtacagacgcttcatcgccagcccttttgtgaatgatgaagtgaacgcacttgccgaagaagcattgaacaaaagctccatcggcatggatgacattactgacttattggcactcacttattatgcaggaaactacgcacataaatccgtacaggaatgtgccatggaaatacaagacacctacgtgcgtctcgaccgcagcatcgaaaacctgctcgaagcgctcgacaagaaagtaggactacaaaacgtgcttattttcgtcacttccaccggatatacggacagcgaatcggctgactcgggattgtacaagattcccggcggagagttttatctcaaccgttgtgccgccctattgaacatgtacctgatggctacgtatggcgaaggaaagtatgtggaagctcaccacaaccagcagatttatctgaatcataaattgctggaaaagaaggaactgaatctggcagagatccaacaaaagtcagcagaattcctgatgcagttcagtggagtgaacgaagcatattcagccaaccggctgttgctgggttcatggacaccggaaattcataaaatacgcaacggctaccaccgcaaacgttcgggcgacctcgtaatcgacgttcttcccggatggaccatcgtcaacgagaacggcggcgaaaacaaagtggtacgtcattcttatatcccttcaccgctgattttcatgggacattccgtaaaaccggccattatccagacacctgtaaccattgaacatattgcgcccacactggcacatttcatgcgcatccgggctcccaatgcctgtacttctgctcctattaccgacctacggtaaaaatttactcacaaaaacagggagcaaaacataaataaatcagcattttaatgtaactttgcggagattattcgccacaaatcccacagattcacacagattaaaaagaaagatccgtgttctatatgaaaaaatctgtgtaaatccgtgaaatctgtggtgcagaaaaagataaataataaactaaataatataacatgggatttaatgaatttttaagctcgattttcggaaacaaatccacacgagacatgaaagaaatcaagccctgggtggaaaagatcaaagctgcctacccggaggttgagaaactggacaacgacgccctccgtgccaaaacggaagaactcaaaaaatatatccatgaatcggctaccgccgaacgtgcgaaagtggaagagttgaaggcaagcatcgagacactggaactggaagaccgcgaagaagtcttcgcacaaatcgataagacagaaaaagaaattctggagaaatatgaaaaagcactggacgaagtactgcccgttgctttttctatcgtgaaggccactgccaaacgtttcacagaaaatgaagaaatcgttgttaccgctacggattttgaccgccaactggctgcaacgaaagatttcgtacgcatcgaaggcgacaaggccatctatcagaatcactggatagccggtggaaacgatacggtatggaacatggttcactacgacgtacagctctttggtggtgtcgttctgcacaaaggtaagattgcggaaatggcaaccggtgaaggtaaaacattggtggctacccttccggtattccttaacgcactgaccggaaacggtgtgcacgtggttaccgtgaatgattacctcgccaaacgtgactccgaatggatgggacctctttatatgttccacggattgagcgtggattgtatcgaccgccatcaaccgaactccgacgcacgccgtcaggcatacctggcagacatcacgttcggtacgaacaacgaattcggtttcgactacctgcgtgacaacatggctatcagcccgaaagaccttgtacaacgtcagcacaactatgccatcgtcgatgaggtcgactcggtattgattgacgacgcccgtactccgttgattatctccggtcctgtaccgaaaggcgacgaccaattgttcgagcaactccgtccgttagtagaacgtctggtagaagcacagaaagtattggctaccaaatatctctccgaagctaagaaactgatcgcatccaacgataagaaagaggtggaagaaggattcctcgctttataccgcagccacaaggcattgccgaaaaacaaggctttgattaagttccttagtgaacagggtatcaaggcaggtatgctcaagacggaagaaatctacatggaacagaacaacaagcgtatgcatgaagttactgatccgctgtatttcgtaatcgacgagaaactgaatagtgtagacctgacagacaagggggtagacctgattaccggtaactctgaagacccgacattgttcgttcttccggacatcgccggacaactttcggaactggaaaaccaacatctgaccaacgagcaactgcttgaaaagaaagatgagcttctgacaaactatgccatcaaatcggaacgtgtacacaccatcaaccaattgttgaaggcttacaccatgttcgagaaagatgatgaatatgtagtgatcgacggacaggtgaagatcgtagacgagcagacaggccgtatcatggaaggtcgccgctactctgacggattgcaccaggctatcgaagccaaggaacgtgtgaaagtggaagctgctacgcagacctttgcaacgattactttgcagaactacttccgtatgtatcacaaactgtccggtatgaccggtactgctgaaacggaagcaggcgaactttgggatatctacaaattggacgtagtcgtgatcccgaccaaccgtccgattgcaagaaaggatatgaacgaccgcgtttacaagacgaaacgcgaaaagtataaagctgttatcgaggaaatcgaaaaattggttcaggcaggacgtccggtattggtgggtactacctcggtagaaatctccgaaatgttgagcaagatgcttgccatgcgccatatcgagcacaaggtattgaacgccaaactgcaccagaaagaagcggacatcgttgctactgccggtttgagcggaacagtaaccatcgctaccaatatggctggtcgtggtaccgacatcaagttaagtccggaagtgaaagctgcgggcggtttggcaattatcggtacggaacgtcacgaatcccgtcgtgtagaccgccagttgcgtggtcgtgcaggacgtcagggtgacccgggttcttctgtattctttgtctcactggaagatgatttgatgcgtctgttctcctccgaccgtatcgccagcgtaatggacaaacttggtttccaggaaggcgaaatgatcgaacacaagatgatttccaattctatcgaacgtgcccagaagaaggtggaagaaaacaacttcggtattcgtaaacgtctgttggaatatgacgacgtgatgaacaagcagcgtacagtggtttacaccaaacgtcgccacgctttgatgggtgaacgtatcggtatggacatcgtgaacatgatttgggaccgttgtgccaatgctatcgaaaacaatgattatgaaggctgccaaatggaactgcttcagacattggcgatggaaactccgttcactgaagaagaattccgtaacgagaaaaaagaaaagttggccgaaaagactttcaacattgcgatggataacttcaaacgcaagactgaacgtctggcacagatcgctaatccggttatcaaacaggtatatgaaaaccagggacacatgtacgaaaacatcctgattcctattacagacggtaaacgaatgtataatatctcttgtaacctgaaagcggcttacgaatcggaatctaaagaagtggtgaaatcgttcgagaaatcaatcctgctccacgttatcgacgaagcatggaaagaaaacctccgcgaactggacgaactgaaacattccgtacagaacgcaagttacgaacagaaagacccgctgttgatttataaactggaatctgtgactttgttcgatgccatggtgaacaagatcaacaaccagactatatctatcttgatgcgcggacaaattcctgtacaggaagctccggacgaacaggctgcccgtcgtgtggaagtgcgtcaggccgctcctgaacaacgtcaggatatgagcaagtatcgcgaaaacaagcaggacttgagtgatccgaaccagcaggctgctgccagccaggatactcgtgaacagcagaaacgtgaacccatccgtgcagaaaagactgtaggacgtaacgatccttgcccatgcggaagcggtaagaagtataagaactgtcacggtaaaaacctttaagaagttgagaagggagagttgagagttgagagtaaaaagttgggtaagtaggagtttctatttctttgcactcatttttgaatcagcttcgctcaaaagccttatttaatttttaacattaaggtataatctcaagtttcaatacacaaaagaaagtctcaaacggttaaaaactgtttgagactttcttttattcctccaaaattgtacttttgttcaaattactaaatagaacaaaactatggcaaaatcttattcactggctttcgtcactatcttcctactgacactgggcagctgtcagagtttggaacagatttccattgattatctgcaacctgccgacttgagctttcctccgcaactctggaaagtagctatcgtgaataacaccagcaatatcccggataacaaactaataacaacgactgaaaaaatcaaagaaggtacaccgctggtaagtcgtgcaactgcatacgctaacggagatcccaagattgccaccgaatcactggctgaagaaatcgcacatcagaattattttgaagaagtagtcatctgtgactctgctttgcgggcaaatgataaactggcccgcgaaagtacattgagccaggaggaagtccgtcagttagcctctagtttgggagtggattttatcattgcattggaaaatctgcaactcaaagcaactaaatctgtccgttttctgaatgagttcaactgttttcaaggagcagtagacgttaaagtatatcccacggtgaaagtgtatcttcccgaacgtagccgtccgatgactacgctccatcctaacgacagcatcttttgggaagagtttggaggtactgccgtagaagctgccacccgcatgattcgcgacaaacaaatgctggaagaagcggcggtatttgcagggacagttccggtgaaatatctcgtccccatgtggaaaaaaggaacacggtatctgtataccggaggctcggttcccatgcgtgatgctgccatctatgtacgcgaaaattcatgggacgacgcatacgaactttggaaccaggctttcgaaggtaccaagaaccaaaagaagaagatgcgggcagctctcaacatagctgtttattatgaaatgaaagatagtctcgccaaagcggaagaatgggcggaaaaagcacagcaactagccaagaaaattgataaaaagaatatcacagatagtgttcaggccagcattgacgatgtgccgaattattatcttacgtccttgtatttagccgaattgaaggagagaaacgctcaattacctaagttaaaattacaaatgagccgatttaatgatgatttttaaggaaattgtgtatcaaatcttattttttttatacctttgaacttataaaaagaaggaacccatgaaactaagccaacaatcactatccattatcgaatcggctatccaaaaggcagtcgctaaatatacatgtaactgtgaacaaacagttgtaaccgacatccatctccaaccggaccagacatcgggacaacttaatatttacaatgatgatgatgaagaactggcgaacatcatggtcgaagaatgggctacgtatgaaggggatgatttccttgaaagcgtggaaccttctctacgcaacattctttgcagaatgaaagatgccggagacttcgacaaggtgactatcctgaagccttactctttcgttctggtggacgaagagaaagaaaccatagcggaattgttactggtggacgatgatacgatcctcgtgaatgatgaattgctgaaagggttggataaggaattggacgagttcttaaaagagttgttggaaaaataatatacagcatttttaggatagagttcgttcagaattaatataaatatccgaaagcattatataaagagaatcggaagcaagcagggtatttcctgttgcttccgattatttttatagatacttccctattgattatttattatatttgatcgagatattagcaagtcgaagcggcatgaagcccgatacgccggacggaagtcgaacaggtcgcaatctgatacagatattatcgcggttcaataaggcatccggcaacttaaagtcatagactttataaccaggaatgttcttctccgtctgtccacctgcagccgttctatcaaactgtcccagaatggtaaactctgaattatctactttcacccattcaccactcatcgaataagcatattcaaccacagccacagggccacctccccaacttgcattcatttcaacctgaagagacagggatgtagaaatacctactgtcgatattttgtctacgtaaaaatatgaacttgtagaccacggtttactattgaaagctcctcctcgcatacgcccataatatccatctgtggtattaagattcatatctccccggaaatcatcctggaaacctaatatgtaatctgcataggtttgctggaaatgcttattcccgtctttattaagaatagcatttgactgcgatgcttctccgcctgtcggatgatactccgtaaatgtagaagcacctatttctttccaatcgggcacattacaatcccactccacgagcaccgaagtgatctcgttcatatcaccgatattgatgtcctctctatgaagcggaagaatacacaaccggctttcggagatgtcaaaattggtaagcttgactttcgctacgattccggtgatggttcctgaacctctaggaagtgtctcatgcgcataaggagcatcgagcgaagtaagcatatatgtattagagccgtttttatctctgatgcaggttggatagtatctgtagtatgccgggaatttctccacccaataatttttattcgccttacggtcggcagctcccggatcggtagtcttgaaattagtaaatgcgcctaccggagaggcaatctcgacatcttttaaggtcacaaggctgaataccatattatccgttagttctgcgattgttttttcaggaatcgtgaaggtggaaagttccgaactgattacatgggcggcagtgataccgctaatcagtctgtaggtaaagctgccctctgattcttcctttatcgttccatctttcaaacacaatgagaccttggcaaattgcgcaaatgtaatcagagactctgattcaaataccactgtctccccggtctcattctgaatgacataacgattgttcgggaagtttttcgatgtaccagtggcaacgatcgttccttcaatatatacattgttagtaattccaccgacaggatagccataaacggttggatagctgacaagttctgcattcgcatattcagaatatgcttgcgacaggttgattgtagtcgtggctttacgttggtattgatcgtcataactcaatacgatacttcctgtgcggggtgattgagaatttgtttccgtattgaaataaagttttccgtcacttatccgatactctttcacccattccactgtcggcgtaatcacaatatccgtttcaggcacattggtcgaaatatccatattatattcgcctcctttggtaaagagttccatattatcactggcaggaactataaatggataacgggatagttgttttatcttgattacatccgaagtcttcccatcttttgtaaacacacgaatatcacagaaacgttcggaatcactgatattttcatcataagtcactgtgaaataagttcttgatgactgggctccacgtatatctgtagaaaaccaggttgattctgcaaagtctatgcgccactcggtattggatttcacttcaacctgaaccggagtaccttcagcctgaagaataatctcattatttgttatttccaatatgccggcttcattttcgtcagagcatgacggaaacatgataattgccatcacagccccaaaagctgcccaagctattgaatctttaattttcatattcatcaattattagatttaatttcacctgttttatatagtatctcataagcttcatttcgatcattcaacacaaagatctgaaacttctctcctcccggataaacacgtgtaacaacatgtccggcgggttttatcttcaaaccgtcttcacccagcctgctcctgttactgtctaccataccggcggcaaaaaccgaccgttcaccggcataaaggctttgagacagcatccggcttagcggagccggttgaggatgatagtaatcccacacgggaatcacgtaggcttgcgctttcacttgggaaatgtaggtatcacacatagcgtcagagtatgcatgatgattggccactaccacatctgtttcgcccagcaatgtagctacaggtgtttctatgtcaaaccattccggcgctttttccactccaaggatatctccgcccgagaagtaatcgaaattaccgtatgtgatacgtattccgcaactgcaacggttctcgttcaactgttcgctcgaagaagcggtagatggcacaagctctttggaagtcgttccgctgcctgtccaaattttaccgttacccacaatattacgtacttcgaatgtaggataggaacccggagcttttaatagtttgatttgtgtgttacttcctgtcacaaacccttcattctttttaccttcccggtcacgagcggcaacatataatttatagtttgagatatgggcacccgtaactttagccgccgtcggataatcgtatgtaggatagccacgatctatcaatgtggaaatatccagaagattacccacatgagttattccggtaagtttgtagtccagccctactttttcgattgccagttttccattttgtccgatatggtctgtatcgaagtgagtgagcaaggcataatcaatagcaccgttatttttcaacggcaatgagaaatgttttatatattgggcaatccattcagcaggccgtttagagtcattaggaactgctttcataatctcctgggtaccggtgtgtactcccaaatctcctgcatccagcaacatggtagtcccgtccgggaaaataagataggctgcattccctcttcccgtgctaatctgatgaatgtccaaataaccagcctgccactccggaaggtattcatacactttatctacagcatcatccggaaaaggcttttcctgttggcaactagcgaatgtaggcagcatcataacggctcctagaaataatatcttactattcattgttttattctttaatgttctattaatcaatttgtttaacactgtatataccggcttcctctttcgtcatttcattgccgcctccatatcccggattctgtctcaagacgttgctgacggaaattgatttttccggaataggaaagagttcataatgatcgtcattagtagctttgtgatcccaccaggtgcctgttgtatataagccccagcgacgaagatcggtacgacgacgctgctcgccaagaaattcgaccatccactcatcgagaatccgatacttgtcaatattcgtttcagtcaccggatcagggtctacttcattctcaaagttgcgtttacgcacttcgttgaaaagattggctgcttctttcttatatccgcttctgtatttacattcggcaagcatataatagatttctgcaaaacgaagaaccggatagtcaggattaaaagcaagtgtcttgtctgtattgtccggcaccggcagtttgcacaaacgtattcccgaattctcttctccggtacttatattggaaggaagttcatttacggaagaatattctccgtctttcactttcttaaattgtgctacctggtcaacaaattcaagaacctcacccgggtattcatacagtcccgtacatttcacctctgttccacttcttgatatacgttgtaattttccgtaaagaaacattccttcgtatttgccatttcctttatatacatacaatttcttacgaaggtctttcgcatgaaacttggcaaaaggacgtccgagtttgtccgtatagggatcaccattgggtttcagagatggttgaagatgcataccgttcgtagaggaatagccgctaagatcgaaatagttcttcgcattataatgattataacgttcgaactgccactgaaacagagttccttttgcatattgcgactgaacggaccacatcacttctttcgacttgttattttcgaaggtgaaaggaccgaaccagtcttcttccaactcgtaatagccgtatttaccgtctagtaaatcctgacaaatctgcgcacattcagcaaagcgactttcccctgtatagacttctgcattaaaatataattgagcaagtagagcagccgcggttccttggcgtaagtaaccttcttccagcatatctgctgtttttttctctagtttggggatggcggcaagcaggagttcttccacataattaaaggtttcccgtgctgtggaacgtggagattcctctgtggtagaacgtcggtaaataggcataccgccatagaaatcaagtcctctcaaatagaaataggccactaatgtctggagctgcatctgatgatctgccttcagttcttccgtcatacctaatgaaacatagtctacaccagctaagtcttctttacaggctaaagccatggctactcccatacctactccacgccatgtttcttcgttgttggggtgaagtggtgtccagtcatggtgttgcagctgggcgtatcggacatcattgtaatgtattcctttttgtgtgacacacatctcgtctgttgtacattcctgaagaatggcacggtcgaatccgtgaaaccaacgccagtgcgtgaaagagcgtaccagaaaagagtagacagtttccttagatgtgaaataagtatccggagttacttcggaataccacttctcatccagattagtacaaccggaggccaccagaagggtgaggaaagagattataattagaatatttcgtctcatatcattatattagtttataggtactttactattagaattggattttcataccaaaggtatatctacgagtttcaggataaatattattaaaccattcataaccgggatccaaaccgttcacattcacttccggattcaatcctgaatattttgtaaaacaggcaacgttacggacggtcaggtaaagatcaatcttatctatatacttttgccattttttcatgttaagagaataccccaggctaatggcatcaatcttcaagaatgtaccatcctcaagccagtaatcgcaaagttgctttacttctttgatgtgccggttatcaatgtatgcgttgcgaagaacattctggcctgccacttcagaaagtccatagtacatatttatggtattgaacacatcgaaatcgatccagctacgcaggttgatgcctaaagagagatttttgtaagtgaaggtatgatcccatgataccatcaatgcaggaatggcattgccgatatatcgtttgtcgtcatatgtttttttatcgctaaggattacattgtcattcttatcatacagaagccacctgccattgtccgtgataccggcatatttccagatgtaatagcttccgatttttgttccggcctcaattctaccggctgatccgtttgtacccggtgacggaaatcctacacgatcctgataggtattattgccccacaaagaggtaattttggaggaagagtgtgataggcgcatagtagttgtccaattaaagtttctggttttgacgggtactcctcctatctcgaactcccatccggtattctcaagattaccgtaattcatggtggttgtttcataaacagcgggaggattgggaacgttgatattatataacattccggaaactcttctcttatagatatcaaacttaccaaaaagacggttattcagaaatgcataatccaagccgatgttaagctctgctttcttttcccagtgcaagtcataattgacgttacgggccggtccataagaggtgatccatgtaccgttataaggccacattgaattggaagaatacatggcagtggatgctcctgcagagaaattgttatttcccgttacaccgtaaccaacgcgtactttaaggtcatcgagaaaactgacgtcacgcagaaatgcctcattggatatacgccatccacctgatactgcccaaaatgttccccaacgatgattctttccgaattttgacgagccctcgtggcgaacacttcctgtaagcatatagcggtctttatagctataattcgcccggccaaagaatgaaataagacgttcacggggatatttgtgggaagacattgccgcctttccgtcggaaagccagctacctgtccccatatcccaagcccctactccatccacaggaaaatcgtagttagtcatattaaagttttcagagttattttcccaataactatatccggctaccgcactaaccgtatggtcgtctgcaaaaacacgcataaaattgatggtaggttcaaaagagacattgactgttttgctatatgcatgaaatcctcttcctttataacttccatttaaagaggttctgtgtaacgcggacgtataatgtgtctgctgatactggcgatcttcccagccaagagtggcttgtgccgagaatccggcaggcaaattgagctttaccgttgcatccgccttcagccatttatcaacattatctgcctgtttcaacattacttctgctaaaggattgtaatattcactaccaccaaccaatacattatatcctgtttcactagtgctgtcatatacatgttccgtcggattcatcttcaatgccatgtcgaaataggaactactgctccgctgatcccggtgtgcttcccggtattctgtgtgcaagcctatttccaacaagtcattgagaagattaaagtttgcattgatacgccccgaatagtctttacggttgtcaccaattgcgatacctttttgatcctgtgccataatagtagcatatattttagctgtatggccgccgcccgagaggttgacaacatggcgttgggagagtgctccttcattcaaaagttcaccgtaccagtcggtggatgcccctaaatcagttcctactccaaaccttacgaaagcatcacgatcaaggacctgcggtctcctggaaacttgctcggtagagagttcgcccgtatatgataaggttatgggaccttcttttgctttcttggtagtcactaagatgacaccaccggctgctcttgttccgtaaatagcacctgcagaggcatctttcaaaacatcaatagactgaatatcttcctgactgatagaacgtaaatcacctccgggaattccgtctatcacaatcaaaggagaagaagaagcattgatggacgctactccacgcagctggaaactggcagaagcattcggactggaagtctcggaaacattcataccggagattttaccctttaaagctgtcgcaatagtggagcctcccattccagtcactaaatctttggatgatatggaagtgatggaactggtcactgcacgtttctccatcgttccataaccgataacgactacctcatccagcaactgatgatcttctttcaataccactgacaagtttgtacggtttcccacctttacttcaagagactgaaagccaatatatgaaatcaccaatatggcatcggaggcaaccgtcaacttaaattttccatctaaatcagaaactgtacctttcccaaccactcctttttcctgaatactggcacctattaccggctctccctgtacatccgatatgataccagatacaatcattttcttttcctgttgcggtgactgtacctcaacagacagtataatcttcttgtctagcactgaatatcgcacgttagtgccagcaaaaacttccttaagcacactaaatatattacttctatcaactgatatagatacgcggcgattcaaatccacatgtttgttattgaaaaagaaatcaaaatcagactgctcttcaatctcttttaaaatatcctccacccgctgattgtgtacatcaatactgattaaagttttttgtgcataactatcggacgcataacatagcccgatagagcataccaagaataaaatcaaaagtctcatagataatgggattttgttagaaactcgccaaagcgactttaccacccataaaaattggatgctaaaataattttgcataaatttgtgatgacttaaagttaataaaaagtttatctaagcttgtcgccaaacaagcatcaaaaagatttaccgatttccatacgggaagatacgccaatatcatcccgtatgttttttaactaaggggctctgtctttcattgcattttttgttttaaggttaatcaatcagtatatttctattttgctcttttcatccttcatatccggcgaatcaagataacgccagcggatttgagaagaaagttggaagtattcaaggatacgttccaggcgttggttggtaaatgttcccgtaaatgaatctcctttcaaacgatcatttttaataatgaattccacattataccgtttttccaacattcgcaggccttcttccaaaggagtatttctgaatataatcttaccttctttccaggcaatctccgattctccggaagtggcataaagctgaaccttattatcttttgaatcatagaccaatttctgtcccggatccatcagcacttttttcgagacatcatttgatttataaataaaaccgatctttccttctaccaatgtcgctgaaatccgatcttctttttcgtatgcctctacattaaaatgagttcccagtacttctatttgtgattgatgggaagtggagactataaatttcttttccggattcttagccacttcaaaataagcttctccctgtaaagtcacatttcttgtatcattatcgaaacgtgaaggataacttagtgttgattccgaattcagataaacaagcgtaccatcgggcagggtcaatgaggtcatcatcccaggatttgttttcacttctatgatttgtgccaattcctgttcgtttcctccccaatattggagcatcaatgtaacgagaagtggaatgaacaaaattgctgccgcacgttgtgcccattgccaccacatcgttcccttgtgtctgttacccgacattctacttttcaccttcaacaatgctttctccgtatcgactttcttcataacattaactgtatccgtggcaagataaagagcatgtatctgttttgccatccgtcgattttcgtccgattcgctcatccacatctcaacttgcagacgttcttcttccgttgccaccccttcacaataacggggaagcagttcttctatcgtatttctatctgttttatccatatctgtttttattgccttttactatatgacaaggaagaatgggaagactcctaaactaaaaaccattttttttcaaaaaatctttgtttctatctaaaaaagctatatttgcagtaaattatggagctaatacatgaaaggaacttatcaatcagacaatgattttctattatcagccgttcaacgcggagatcaaaaagcgttcgatacactgtttcggagatattatccgatgctgtgcgcgtatggtcaccggtttgtcgagttggaagatgcagaagagattgtagaggattctcttttatggatttgggaaaatcgggaaacactggttattgagtcctctcttaattcttatctttttaagatggtgtatcgcagggctttgaacaagcttgcacatatcgatgccacccaacgggcagatacccgcttttatgaagaaatgcaggaaatgctgcaagatacggactattaccagattgaagaacttgcgaaacggattgaagatgctgtcgcggcactgcccgaaagttatcgggaagcttttgtgatgcaccgattccgggatatgagttacaaggagattgcagaaacactgggagtatctcccaaaacaatagattaccgtattcaacaagcgttaaagcaactgcgcgtggatttgaaagattacctcccgttactactacctctcttatttccctagagagacgaaacatataagtaaccaccaatattatttcatttggctattacctgtcagctaaagtattaatagataacttgcgttgtattaaagataaacttacgttcctctaaggctaaagttccctttgacctgaaacaaactataaacgcaagttccaattatataaatgtaatcttcatttttataaacgcaagtttcatttataaaaacaaagcttccgtttatagatttctcttagacaaaaacaactttggcagtaaggaaaaggaagtttgcaataaggagacagtaacttatctattaactaacttcatctctttctataaggaagtgtaaaccagaaagtagatcctttaccttcttctgaatctactcctatttttcccccgagacgctcaacaatcgtacgacaaatggaaagtcctaagccggtaccttgaatgaatgggttatattttacgaatcgttcgaaaacatgttcacactgttcgtttgacataccacagccggtatctgatacataaaaataaatagtatcggtgtctgtcatacgataccccatacagatagtgcctgtttgagtaaatttgatagcgttattgacaaagttggcaagcaattgtatcagtcgattcttatcaatataaaaaagacaacccggcaagcgttcggtaaatgcaagggtaacatcattgtttttcaaacgtaactgcatactttgttcgatttcctccattgtctgattaacatcgatcgaggaaggatagaaatcaaatgttccggcttcaatcttcgacaaatccagaatatcattaattaattggagcaacaagtcggtatttgtttcgatgatatctgcgtactcgcgcatttcgacaggatcttctgtatggggaagcatatttgaaaagcccacgattgcgttcaaaggagtacgtatttcatggctcatgttcgccagaaaggcagatttcaattgattagcctgctccgctttctccaccgcttcactcaaacggctatacgctttccgaagaatacgaatataatagacaatagcagctatcaaaagtaatagaaaaacagaactagcaataatcttaacatagtgttgctgaaaaaaagtttgaggtttatcaatatatacagcatcgtcgggataacgacttgacggaatattataagactttaatacaggataacaaagataggcatttccttcccctcccactccacccgggatattgcgggcttgttctccattcaatatgcgattcaggatttccagcaaagaatcgcaaaaagactccgtcgatacataatatcctcctgcgaaagtattgttcgataaattttcgggagatagcaaaaacagaggtgagggagtaaaattggttataatttcctgtatgtggtcgaaaaggtagttgttatcattttcattatgagactcaaaccaggaatagtaaataatccctgtattaggtttataactatgcagggtatccagcaacatttctgtcgataattgagtggtagaaagcagatccaaacgtaaatccggaaaattttcttcgacggcttcctttacatctctacgggtttcttcactaatatatctgtcgtctgaaataaatgccagacgttgcatatccggtattagtttataaatcagttccactgtttccttcacataataatgctgctttaaaagtgtcagattatagcctcttctccattcttcaccgaggacactattggtttctgttagtggagcatgagacagcaaaacgtcgagagaagcaggcaggcggtcgcgggcatttgtcactattaccggaacgtctttccatacgtcatcaaacagttcacggcagacaatccatcccggatctccaatcaagacgatggcagcgggagctaccgggtatttctcacgcaaatgggtgactacggcatctgcttccatcttattagccaaagctggtacggaaagggattccgctttggcagatatcccctgcttctgaagagcatcgtgtatgcaccaataaaagtttttagcccaaggcagattaaaattaatagagtttaaaaccagtacttctttatttgttgtttcagttcgggctgacacagataataagaatccttctataaaaaggaatatgcttaagaatgagatggttcggagtacttgcttcatttgtgaggttcgataatagctacggcaaaggtagtatttatttccatttcgcaaaaaaaagacatctcaaaattaatcgagatgccttatattattgaaatttagctatcagagagttacgctttctttaaagcagcaatgctttctttcaaagaattaataatactttcagcatcggtctgtttcttgcgttccagttcgagaacagccgccggagcattgttgacgaatttttcattgctaagcttcttcattacgccttgcaagaatccttctttatgcttcagttctgcttccatacgggcaatttccgcttccacgtcaatcatattacccaatggtaccgcaaattctgttgttcctatcatgaaagaagcagcaccttccgatttgctttccaccactgttacagcagacaggttacacatcttgataatcaccggattcattttttctaccggatgactatccacaacctgcaattcgagttgttccttcaaagcaatattcttttgcaaacgaatgctgcgaacattgctgataatttccttagccaattcaaattcttgcaggaatttctcgtttacctcaagaggctccttcatgagagtaaccatcaaacttgcacccggttcgcgctcacgcagttgttgccacagttcttctgtgataaacggcatgaaaggatgaagcaactcaagcagacgttcgaaagaactaagcaccatactataaataaagccattaatgggctgtccataagcaggtttcacaatttccagcaaccaggaagagaactcatcccagaacagtttgtaaaccaacatcaatgcttcgctcaaacgatatttagagaacaaatcggcaacttcaaccgcagctgcatccagtctctggtcgaaccattgaacagccagatgagcatcgggtggaactggaatggaacctttgccattagtccatcctttaatcagacggaaagcattccatatcttgttgcagaagttacgtccctgttcacaaagggcgtcgtcgaaaagaatatcgtttccggcaggagctgaaagcatcatacccatacgtacaccgtcggcaccatatttttcaatcagttccaatggatcgggagagttaccgagcgatttagacatcttacgtccctgtttatcacgaacgattcctgtgaagtatacgttcttaaacggcatctgtccctcgtattcgtagcctgccataatcatacgggctacccagaagaagataatgtccggccctgtcacaaggtcacttgtcggatagtagtatttgatttcttcgttgcccgggttgttgattccgtcgaacaaagagataggccacaaccaggaagagaaccaagtgtccaggcaatcttcatcctgacgaaggtcttccattgtcagggcggcattacccgtcttttcttttgcttttgccaaagcttcctcgggagtagcggctactacataaccaccttccggcaggaagtatgcaggaatacgatgtccccaccacaactgacggctgatacaccagtctttgatgttttccatccagtgacggtaggtattcttgtatttggcagggtagaatttcagatcgtcgttcattaccggaggcaatgccatatctgcaaaatgttgcatcttgaggaaccattgcatagacaatttcggttcgatcacaacgttggtacgttccgaatatcctaccttatttgtataggcttctattttttcgagcaatccggcagtttcgaggtctttctctatttgtttacgaacatcgaaacggtccatgccgatatacataccggcagcttcgctcaatgtaccgttgtcattgaaaatatcgatactaggcaagttgtatttttcacccagcatatagtcgtttacatcatgggccggggttactttcagacaacccgtaccgaattcgatgtctacataatcatcctcaatcacaggaatgacacggtttaccagcggaacgatcactttctttcctttcagccattcgttcttcgggtcgttcggattgatacacatagccgtatcacccataattgtttcaggacgggttgttgcaacaaccgcgtagcgaccttccggatcaccttctactttatagcgaaggtaatacagttttccgtgttcttccttgtagattacttcttcgtcagaaagggcagtcaaggctttcgggtcccagtttaccatgcggacgccccggtagatcaatcctttatcgaacagatcgacaaataccttgattacactttcactacgtttctcatccatagtgaaagcagtacgatcccagtcgcaggatgcgccgagtttacggagttgtttcaggataataccaccgtgctcgtctgtccattcccaggcatgtttcaagaattcgtcacgagatagatcggttttcttgataccttgagaagcgagtttgtttacaactttagcttcggtagcaatagaagcgtggtcagttcccggcacccagcaagcattcttgccttccatacgggcacgacgaactaaaatatcctggatggtattattaagcatgtgtcccatgtgtaacacaccggtgacgttcgggggcgggatgacgatggtgtaaggttcacggccatcgggttttgaactgaataatttgtggtccagccaatactggtaccactttccctccacgtcagcgggattgtacttacttgctaattccatattgttttatgtatatgataatgtatattctaaaaataacgggtgcaaaattaataatttaaattcaaatcttaccaccctcggggtgtttctgtgcacggaaagagaatttatatccctcataaagagcgaatccgtagaatagggcagtcatcgacattacatttttcaacagaatagagaatatctctccatagtctacacctgccaggacttgaaaatagcccatatcgtaatcttgagagatatatccgataatagacaaaaaatcacctaagatgcaactaaccagagataatgccgcaccgataattccgaaaatgggacgtattcccttgccctgccgcatcgcaaaacctaccatgaatccgatagcaatgggcataaacccaatctgacgacctgtagaaacggagatcagcccccatgccaccgcaccaacgatgcatgcgacaactgcacacaatactcctttggacaggttctcttcggcaagcatttcctcttctgtcatggataccggaaagtcttccggcttgggaggcgctaatctttccagttccttatcttgctcaaaactgtcacattcttcttcaaaagcgggaagttctccggtacgtttacaaacgagtccttttccgttcacaaaatcacgtgacacgcaattcctgcaatacttttctatttcttctgatgtagccatcttatccggtttatgttgaataactttctctgattacgcaggtacacaaagtcactgttaacagattttttgcaaatatagaggtattttttcgcgcgacgtttattaaatgcatatttttgttgactgattttatacaaatgatgaaaaataagccaaatgtaagatatttagccttaggagcattattaatcctggtgtggctaacgcaatggattcctgctctggcaacgatctattctcaaacaatctatccccttatctcctacgtcctgtcgtttttttccggtttatttccttttgccataggggatttatttattttccttagcatcacaggcgtgattgtttatcccttttatgcccgtctccgcaggaagttaccttggaagaaaatcttattgcgtgacggagaatacttattatggatttatgtatggttctatctggcatggggactgaactactcgcagaaaaatttctatcaacgaacagaaatcccgtataccgcctatactcccgagattttccaagaattcgtagatgattatattactcaactgaaccgctcgtatactcctgtcaatagtatcaatcaagatttaatacgagaggaaactgtgcgaatctatcatcagttaagtgatagtctgggcgtacatcgccctccacacgagcatccgagggtaaaaacaatgttattcactcccttcatttcgatggtaggggtaacgggtagcatggggcctttcttctgcgagtttacacttaacggagatttgcttcccgttaattatccggccacttacgctcacgaattagcccatttattaggtatcaccagtgaagcggaagctaatttctatgcttatcaggtttgcacccgttcagaagcgatgggaatccgtttttccggatatttctctatattgggacatgtattgggaaatgcgcaaagattactcccggaagaagaatacacccggctgtttaaacgcatccgaccggaaattatcgaattggctaagaataatcaagcgtattgggctgccaagtatagccctgtggtcggtgctgtgcaggattggatatatgatctttatctgaaagggaataagatagaaagcggacgacagaactactcggaagtagtggggctgctgatttcctatcaggagtggaaaaagaaataagtatagattgtgccttgttttggcacatagtttcacgatatttgcagcactaatataaaacggataaactgatttctttatggcaaaagatctctttaatagatatctctggttagtagacacaatctatcgggctggaacaataacactggatgaaattaatcgtaaatggctgcagtgtgaaatgagtaatggagaggaaatccccaatcggacttttcataatcaccggaaagctattgaggaactattcgacattaacatagaatgcgatagacataacggatgtaattattacatagaaaacactgaagaacttaaaaaggaaggactcagaaaatggctcttgaatacatttgcagtcaatacaaccctcaataaaagccacaaattaaaggataaaattctactagaagactatccctcaggagaacaatatctgataccagccattgaagctattcataattgtataacgttggaaataacatatcaaagttattggcaggacaaatcatatacatttcaaattgaaccttattgtataaaagccttcaaacagcgttggtatatcgcagcacgaagtccgtattacaacaaagtgttgatctactccctcgagcgaatactcgaaatggaacaaacagatttatcatttgagtgtcctcaaacgttcaatcctaaagtctacttcgacaacagtttcggagttattgtcgatgaagaatatgatgtagaaaaaatcagaataaaagtctacggaaaccaatgtaagtatttccgttccctcccgttacaccattctcaaaaagaaagtgaaacacatagtaactattccattttcgattattcattacgtcctacctatgatttctgtcaagctatactatcgcatggaaatcttgtagaagttctagaacctcaatggttcagaattcaaatcggaacaatgattcaaaaaatgaatcaactatatcaatgaatattatcataaatgtaatgaagtgagtattcattagtaaataataaagcagtccggtcatcttttctgataaaattcttttaattctaaaaaatgtttcttagttttgtgatgtataatcattaaaaagaagtagtaagaaacagagaactaaaattttcagacatattgattgaacgttaagacgtattatttcgattaggtaaatctggtaaatttattcaatgatccgaaataataagttgaagtgacgttcacacccgaatagggcgtggactgcttttacttatttggatcataaggtttaccagaacctacctaatcaaataagctaaaagttagttttacgctcttttttttgtacccatacattcattttaaattatataaaacatggaaaaagtatcattactaatgaaagattcttccgaaggagattctcaaaaagaaaccatgatagactttattctttcatggacattacgtagatctatacagcaatacagtgaagagaaacctatcctttatcaatattgtagaaagattctcggcaaactgattggcatcgaaatgacagacgacgtgcaagtcacttctgttgaaacttggaaacaatggaaatatattgacctatgggcaaacatacggattacatgcaatggaaaagaagaatttcatgctgttttgattgagaacaaagcgtatacaccaactcaccataatcaattagcaagatacaaggccattttcgaccaagtatgtgaagagtatatgcctaatactaaaaggcattatatactaatcaccgccttggatgaaatgccggctatgctggcaaacgaatgtaaagagaacggatatattccattctgcttgggagatttaaatgattatgaacagcaagattcggaaagcgatttgtttaacgagttttggttaagatattggtaactatgggaaaatttctattaatatgcctattcctctgtacaggaatatgtaagacaagtgcacaaatagtagacttatcaaaattcgttaaggcaaagaaaagcaagacagaagtattctctcaaaaattacaaaatacgagagattcacttctaagaatctgcaaaatatataaattagaagatttcaaatataaatttccaactatttacttaggtgaatcaatggaaagtttaaaagctaaatcaaaagaattcgaaaaaatcaaagtagaaatagaaaatgctattagcaagaaagagttagaacaaaaaagagtagactccatccaaaaggtcaatgatgccgaaagaatagtacaagaaagaatagctgattctttatatttaattcgggccgcccaaacatgggaatggttacatgataagaaaggaaaatgggaaacaatagaccgttcatatcctaaagaagagcattaccaagtaaattcactatttccccaatatcaagtaatagaccaaaatgcctatctgaatggaaaattagtaggagtatgccatccggctaaaaacaataaaaacaatagcgaaaaagaacgttgttttcgcatagacgtgatgacttttttatgccaacaagattttctgaataacaaatatgagatacaaaaagaatcacctaaaacccaagaatacataaaacagaaattaggacttaaaaaacagctggagccgactgacagtcctgtatataaagaaatgatagccaatgcaagcaaactccgtatagcacaagaaaggctacgcaaaggagaaattgatttgaacacctacaatagaattaaaacaaaattgggtgccaaattcaccggaacggtatatcaagaaatggcggatagcaacagtccggaaataaatgcagggaaaagatatctggaacaattacgtactgataacaaatcattaattggggaatataccattcaaagaatagatggaaccaacttcacctatcaattccgtaataatgaaggaaaaaaaacgtttagcgtgaaagtttcattctttgtcaatgagaaaaaaaatgttttatatacaatttcttcacttcaaaagaaataagatactatggaaaaagaaacaaaaaaatgccctttttgcggagaagagattttggctgtagccaaaaaatgcaaatactgtggtgaatggttagaagaaaagcaaacggtaactaagaaaatggttgcctgccctgtttgcaccgaacaaagagaagaagatgccacaagctgcgagaacaaagagaccccacagccctctttcttatcccactatttcatccgtgtcatatgcaagcaatatgccgactttaacggaatggccacaagaaagcaatattggctttacatcctattctacaacatcatagctattgccgcatcatgcatagatatattatcgggaatcgacttccaactatttggagaaagcctcggctatggttggctattcacaatcgtctcactgactctcaccattccttcactcgccatcggtatacgtcgcttgcacgacattggaaaaagcggatggtggtttctgattgtcctcctccccttagtcggtatcttttggctactcttcctgctgtgcaagaaaggaaatgcagctaacgcctccactcctttaaccattaccgacaaaattgtgctcaatgcgtcgatagtagttgtagccattctggttgtactcacctatttcaaatctgccaaccatctccaaatgcctcaacttcaacacagcgattggactcttgacggagacaccgcaggagtggatacattgggcaatataggttattcaaaaaacaggcaaagcatcaatagcggaaacaatgcggaaataaaaaaacgcattatacacgatttctcttgctattatgccatttataccttctgctacaacatgaaacaagccataactaaaggatacaaaggagaaggtttgctaaccctcaccgaagaacttgtagaaaatgacgatttacttgtcatctccaataccgaatttaaatggttattgcaacaattcgatttctcaaacttctctcgactattacaggcatacgcaagtggcaacaggagcttcaggagtgatttcaccgagagtgacttggggcatacagcaatagaatgtcttaaaaaacgcaaagttgttttcaacagccaatggtttgagatattcgacaactatttgccccatgacgaagtacaaatagaagagtttcataatttgggaaataaagagtatcaggttgtattcgatggttttcacaacatatctcccaatttcgtatataacgtcagctatgccaacggacttaccattacaacgaattaaattttaccatcatgaaacataacaacttacttacatcattcactctattatctcttttgtgtatcttctgcacctcatgcaacgatatggaaatggcaaaaaaagcgtgcggcacatgggaaagcatccgcatagtcgaagaagacggatgcaaagagaaaacctattatgatttcggttctgtgaaagggagtattcctggaggagacttaaaagaaacaacctacttcaccgaatgtggagaagttgaagacggacaagaatataatatgcaatgcaaaagtatcattgaaggtacatggaagatagaagtcggtgacatctatttcacttacgacctgtcgactctgaaagtcacttttgaggggattagtttcccgggcgcagatagattatccgaatctcttgcacaaagttttattaaaaactatgggcaatcactcattcaagaatcaatagaagaattgaaagaacatctctataattggtattcagaaaacgaaaacaacgaagactgttaccagaatgtgaatattaaaggagacaatatgtcgttcgatgcaacagatggagttattaaactgataagaataaaataaaacttgaaaacatgataaacaataccaaacaatgccctttctgtggcgaagagatacaagcaactgcaaagaaatgcaggcactgcggagaatggttggaagactcagtttccaatacaaaaaatcaagccactacagaagtgtcctttcaaagggattcaaataatcataaaacagaagtgaatcatttaaaaactcccatttctgactttgtcctaatcctattttggacaggagtcattgcgacattcatttcaatgtcacatcaaagtggagtatgccaccttaccaatccacacaaatggctacaaatcatgcagtgggcaacctatattccagaatgggtggctgacttattgtctggcttggtcgatataatattcgcttacgccttatatatagggatgaaacaacaaaccaaacccatgagcggcttattaattaccaatattataatcactgtagtagtatcttttttgattttatgtatggatttaatctctattgcagacgaagattacattggaatacttatctctctttttgttatattaggtatgcttattacatcaaccataattggagtccaatttatccgacacttcaacggactattaaataaattaggatggggaatgttggcatctctaatcatagttatatctgccgccgctctaatatcagaagatgaatttagtatgactaatacaattatttcttttattgagttttggataatcagctatattctatatatacaagcggaattattaacggattgagccaactaaatccctcaagaagacattttcatttgattagccttaccaattgcacaacaaaagtgcagaaaattatagttttctgcacttttgttgtgcaattgacgtatatttgcatataaatatataccaaccatggacagattatacgaaaacttcaataaactccttaaagctacaagtaccgatttcatccgatacaagtatactgaaataaactgggatagccatatgctcggacttgttgggccacgcggggtaggtaaaaccaccatgttccttcaacatatcaagcagaacatgaatccgaaagacacattgtatgtttcagcagacaatatgtactttgccgataattccctgattgacctaacagacaaattcagcaaacgaggtggcaagcacctatttattgatgaaatacacaaataccctaactggtctcgtgaattgaagcagatattcgattcttatcctgatatgcaagttcttttcaccggttcctctattttggatatttataaaggaacggcagatttaagcagacgtgcccccatctatgaaatgcaagggctgtctttcagagaatatttaagtatgttccatcaaattcatgtaccagtctacacattagaagagatactggaacataaagttgaaattccgggaatagcacatccacttccgctattcgctgaatatatacaacacggctattacccgtttagcaaagatatcacttttgaaatcgagttgaaccaagtaatcaaccagactatggaaaatgacatacctcaatatgctaatatgaatgtctccacaggacgtaaattgaaacaactgttgatgattattgccaaaagcgttccatttaagcctgtcatgcaaaaacttgctgacatcattggagttagtcgtaattatttaagcgattacttactttatatcgagaaagcggggatgatagctcaagttcgcgatgacacaggcggggtcagaggtctgggcaaagtagaaaaaatatatcttgataatactaatctcatttatgcattaggaagagagaattccaatatcggtaatatccgcgaaacatttttttataaccaaatgcgagttaaacaggatattatatcttccaaaatctcagatttccaaataggagaaagaacatttgaaataggcggaaaaaacaaaggacaacaacaaataaccggagccaaagaaggatacattgtaaaagatgatatagaaaccggatacgggaatattattccactttggaatttcggaatgaattattaataatagccttataacaattttaatacaaaatatatttatgtcacataccagacaagaacagatggaagccttcggacgcttcctggacattctcgacgaactgcgtgttaaatgtccctgggaccgcaaacagaccaatgaaagtctgcgtcccaacaccatagaagagacttacgaactttgcgacgccctgatgagggatgacaagaaagaaatctgcaaggaattgggcgacgtattattgcacgttgctttctatgccaagataggctcggaaacaggagattttgacatcaaagatgtttgcgacaaactgtgtgataaactgattttccgtcacccgcatgtattcggagaggtaaaagcagagacagcaggacaagtttccgaaaattgggaacagttgaagctaaaggagaaagacggcaataagagtgtattgagcggtgtacccgctgccctcccctcgctcatcaaggcttatcgtattcaagacaaagcccgtaatgtaggtttcgactgggaagagcgtgaacaagtatgggataaagtgaaggaagaaatcggagaatttcaggatgaagtagctaatatggataaggacaaggcggaagctgaattcggcgacgttatgtttagccttatcaatgcagcgcgtctctacaagatcaatcctgataacgctttggaacttaccaaccaaaagtttatccgtcgcttcaattatttggaggaacatactatcaaagaaggaaaaagcctgaaggatatgtctcttgaagagatggatgctatttggaatgaagcaaagaaaaaaggactgtaagacccatgagtaacattgatttacatgccatcattgaaagatgatttggagttcataatacatgccaaacaggatattccactattgattgcagaaatagaatacttaaaatcaatgctgtctaaataaaaaaatagaggctctattccgtgcgagtagagcctctattttactcaaacagaacgtctattcatacgagttagacgctctgtttttctttatttcttcttcgaatcgtttcctttatccttgccacgattcattccttttatcatctcccggtggaagcgcatttccgcacgctgcacgagaaatatcttcttactggaaagaatctttttgaacttacccagataagtcttatcaagctgatcggcagcaatacgattgttggctatcttatcgttgatttctgcatattgagcttccgttgtcttatcatctttacctttgcgcatcaaatcccacgattcatcattcagcttcttcttcttatcctggagttcaaaatagacgggaaagaacttggctgcctcctttttactcaatcctgcctgttcggtaatgaatgccttttgttttgccctgaactcctcccgggataaatgctgatcacatccgtcagcagcccaaagaacaggcataaagccacacaacaaaacaacccatgcgattagttttctcattttctgtattcaatcagttttaataaatcattctacacttgcgtcactcaaataaacatataacgaataatcatccagcatagcgcggtctagtgccacatccagcatttcgtctgatacgacttcagtatccacctccgtcaccgccacttcatcgaccgcagcaggtttgtgatctgtcgacgctacccggataatcagggccgcacctacaaacatagcagcgagatagagcaatggtttcagtcttgtccatgtgctgacaggttcttccttgaaaacaactttttctttttcaggaagtttattcattacctccgatgtcaggttttcaaagtaaccatcaggcactttgaaggaattttccttaccaagcttcttcaataggatatcttcttctttcatacgtttttctcctctcttttacttagacaacgtccaatttaaaaggtttaatctatttcttctaaaaacttctctattttcttcactgcatgatgatatgacgctttgagcgcaccaaccgatgtgccgaagatttccgacatctcttcgtatttcatttcctgataatatttcaggttgaacaccatacgctgtttttccggcaaagtcaatagagctttttgcagacacaactgtatttcgtcgcccgaaaagtaggagtcactttccaacttctgcacaatcgcagcttcaggatcgtcaatatccacggtagtcatagcatgctgcttgttcagaaaggtaagacattcgttcagcgcgatgcgatagagccaggtagacagtttcgcctcggcacggaaataatcgatattcgtccatgccttgatgaaagtgttttgcaggagatcgttcgcatcctcatgcgacagtaccatccggcggatttgccaatataattgctcgctatactgcgccacaatcatttcaaatcctttccgctgtgtactctcctcctgaaggagttccagaacttcgcgttcgttataaggaatcataatctcttgtatctgtatgtttatttatggtttcaaattcaggttgttcattgcctctagtaaagacggatcatatttataaatgtcctcacaatacctcaaattattatcggcagacagataaaccgtctgataatctataaataaaggtatatatttctctaaactataatgtttcagttcacgataggccgcactgataggcagcttctttccctcttcactcaccggcttgatatccattgcaatgcgaatacggtcttccaataattcatccggttctttcaacaagaagaaagcaaagtcgagtgctttctgaaggcggacgcaaccgtggctcaccgcccgattctttaacgtgaaagcccagcgggaaggagtatcgtgcaggtatacggaatgagggttagggaaacggaagatgatgcgtcccaatgaattccccgttttattgtcctgcttcactgtatagggtacgccttttcctgcatatttagcccaattaacctgatgaggatttacttgcaagccgttcttatcgtataccttcatgcggttacgggtgaaataggtcgtatctctgcgataagtagggatgatttctttccggataatactttgaggtacattccaatacggattcagttccatataataaatcctgctcgacaacagaggagttttatttttcacactccccacacagatacgcatttccagaatagagtccgtttcttcgttgattgcctgcaacatgaatgccgccacattggctatcacatatttctgtcctttatccaatgcatattgccaacgtgcccgctccatattaaccaacagacgattccggtaataatccgtagtatccgttttcccccaagcatttacacgaaccagttcttcctgcatcttgcgataaagcggagaagaaggttgtgctccacgaagagcagcaattggatttgcacgcaatgaatcgagggcggcatttgcaaaagttacatcacaatgttttaagggaatacgattgatcgaatcattccatctgtgttccgaaggcaggaaaccaaacttcaactggcacacatacgaaagatatgcggctgtcaactgatattccacatctgccaacagacggttcattgtctttccttcctgcaacttcaaagaacgtatttgttgcaatctctcacggatgctatcgaccgaataaagattcgggttaatgccatgccgtgagatgtctcccagccagaacaacatagagtccgccacctgtgcggcaggtttatcggacacgagcgagtcattcaaccagaagaattcatctttttcccgataatgggccaacaaagccgaatcccagggagttatagggttttcgttcaaataggaacggatcatcagacgaatactgtcggcatctatttgataagcagggttgaacaactcttgcagggaagccagagagtccggtatcggagattggggtttctctttcttacaggctgccaaacaaacgacgaacaggattaccgctccccaaagcaggcgtctatttctcatacacagttcctccatcaacgtcaatacacatattctctttcgctaaaatggtttgcgggaaaatggcggacgcttcattaagcaaaatagattcatcctcgtaacgggctgaaaagtgtccgatcaccaattgtttcacattggcgtccaaagctagttgtgcggcttgcgcagccgtagtatgataagtttccttggcacgtgcctgctctgtctgcgcaaaggtagcctcatggaaaagcaaatctacattgctgatttgttcggcaagcgacgggcgatagattgtatcggagcaataagcatatttacgagccagagccgaaggacgggtcagacgcaaattgggtattacttctccttcgggagttacaaagtctgctccgttcttgatacggttcagttcatagaccgggactttataaaagtccaccatgtctctgatgatatggttcggacgctgtttctcttcaaaaaggaaaccgcagcagggaattcgatgttttaaagggatggtggtcacagtcaccgaacggtcatcgtaaatgagcatcggttctttcgtttcgaattcatggaagaacaccttataagtcaaagtcttacaaaagaaagcaagcatcggtgcaaacagttcttccagtcctcgtggagaatgaatatgcaaatcggctgttcttcccaataatccgaatgtagaaatcagccccaacaatccgaaacaatggtcaccatgtagatgagagatgaagatatgattcaatcgggaaaatttcagtcgcgaacgacgtaactgcatttgtgctccctcgccacaatcaatcataaatagtttttcacgcaggttcacgacttgagaggtcgcaaagtgtcgcgtggtaggcaaagcggaaccgcatcccaatatatgtaactcaaatttttccatggtatgcaaagataaagcatttcagattcaatcttgcaaaggaagaaacttttttttctattcaccacggaggacgcagagggtaagaagggtaaggaggatatggagaagatgcggaggataagaagagggtagatttatataaataaaatatatcgccatcgttagtttgttaaatcaagccttcacaccctctgtattctccatatccttcctgtcctctataccctctctatatcctccctaccctctgtgtcctctgcgtcctctgtggtgaataaaaaaaggcgcccccaaccgggagcgccttcatcagaaaatattctgttcagattatttctttccttccaactgttctttcaatgcagccagagcgtcaatgtcgcccaaagtagttgaagcagcttggttttggatcatcggagaatcttctctcttaccagaagatgctttctttgcgccagaagtagctttcttttctgctctttcttcagctttagctacatcttcgaagatacggctgtgagacaggatgattctcttagcgtctttgttgaactcgatcactttgaattcaagtttctcatccaactgtgcttgtgaaccgtcttcttttacaaggtgtttcggagttgcgaaaccttctacaccgtaaggaagagctacaacagcacccttatccaacatttcgatgatagtaccttcgtgtacagaacctacagtgaacactgtttcgaatacatcccaaggattttcttcgagttgtttgtgaccgaggctcaaacgacggttttctttgtcgatttccaatacctgaacttcgatatcagcaccaatctgagtaaattctgatgggtgttttactttcttagtccaagaaaggtcagagatgtggatcaagccgtcaacaccttcttcgatttctacgaatacaccgaagttagtgaagttacgaacttttgcagtatgcttagaacctacaggatacttttcttcgatagtttcccatggatcttgtttcagttgtttgatacccaaagacatcttacgttcttcgcggtcaagtgtcagcacaacagcttctacttcgtcgcctaccttcatgaaatcttgtgcagaacgcaggtgttggctccaagacatttctgaaacgtggatcaaaccttctacgcccggagcgatttcgatgaatgcaccgtagtcagccataacaaccactttacctttcaccttgtcacctaccttcaagtcagtgtcaagagcatcccatgggtgcggagtcagttgtttcaaaccaagagcgatacgtttcttttcgtcatcgaagtcaaggataacaacgttgagcttctgatccagttcaaccacctctttcggatcgctaacacgtccccaagaaaggtcagtgatgtggatcaaaccgtctacgccaccaaggtcgatgaatacaccgtaagatgtgatatttttaacagttccttcaagaacttgtcctttttcgagtttaccgatgatttctttcttctgttgttccagttcagcttcgataagagccttgtgagatacaacaacgtttttgaattcctggttaattttaaccactttgaattccattgttttgccaacgaatacatcatagtcgcggatcggtttaacgtcgatttgagaacccggcaagaatgcttcgattccgaatacgtctacgatcataccacccttcgtgcggcacttgatgtaacccttgataatttcttcattttccagagcagcgttaacgcgatcccaagaacgagtagcgcgggcttttctgtgtgacagaacgagctgtccttttttgtcttcctggttttcgatgtatacttctacagtatcacctactttcaggtccggattgtaacggaattcattcaaagggatgataccgtctgatttgtaaccgatgttcacaactacttcacgcttgttcattgcgattacggttccgtcaacaacctcacggtcgttcactttgttaagcgtaccgtcgtaagctttttcaagttcatcgtggctaacgttggttactgtttcgccattttcataagcatcccagttgaaatcttcaataggagctacgttctttaagttttccattaataataaaattgtttaatactttaattaaataagacattatattatctataaatcgggcgcaaaggtagaaatattttcttgattgacaaaagaatggcagaagaaaagagatttatatccgtattttttgtaatattgcaatctttaatttatacagtttttgccatggacgagagattggacaaagtcaaggtgcaatgcgactatttaccgcttattaattttgcgatacaacaaaacggagcatcgatcattcatcagctttctattgagaacacgacatctgccccactgaaggacattcaggtagtaatcacgacagaaccgactttcggaaacgccgctccgatggctgttgaacagatcccggccaacggttcgatccgtctgtcgtcattcaatctcactttgtccgccaactacttcacacaactgaccgaacgtttatccggcaacctgaaaattgaaattactgctgaagcagaaccgatattctgccaaacatatcctatcgacatcctggcatacgaccaatggggcggactcaacgtattgcccgaaatgctggctgctttcatcactcccaatcatacggctatctcgccgattatcaaaagagctgcttccatcctggggcaatggaccggcaacccgtctctcgatgaatatcaaagccgcactccggacagggtgaggaaacagatggctgccatctatacagctatcgcggagcaacagattatatacagtaccgttcccgccagtttcgaagaatatgggcagcgtgtccggttagccgattctgtgatggcacagaaattgggaacctgcctggatatggctttgctctatgcttcctgtctggaggcaatcgggctgaatgctttaatcgtcatcacgcaagggcatgcctttgcaggcgcctggctggtgccggaaactttcccggatcctacgattgatgatgtttctctattaacgaaaagaacagcggaaggaatctacgacattactttggttgaaacgacctgcatgaatatgggacattcgtccgattttgacgatgcggtgaagaaagcaaacggaaagttggcggacgggaacaacttccttcttgcaatagacatcaagagagcgagatattcggatgtacgccccatccctcaacgtattttgcacggacaggtatgggaagtcgacgaaaaagagaccaacattcagaaaagtgccgttcatgccactccgcaaagtatcaatccgtatgatttatcgggcaatgaaacccagaccgtaatcaccaaacaactgttatgggaaaggcggttgctggacttgagccttcgcaacaacctgctgaatatccggattaccaaaaacacgctccaactgatcccggctaatctggcttgtctggaagatgcattggctgacggagaagaattccgcatcctgcaccgccctgccgattgggaaagcccggcgatggatttcggaatttactcctctgtaccggagtctgatccggtggttggtttcatcaactcggagctttcacagaaaagactgcgtttttatctgtccgaaaacgatttaggcaaagcactgactcacctataccgttcctcgcgtacctctattgaagaaaacggagccaacactctttatctggctctcggacttttgaaatggtacgagactccttccagcgaacgtccccgctacgctcccatcctgctaatgccggttgaaatcatccgtaaatcggcagctaaaggctatgtgatccgttcacgggaagaggaaacgatgatgaatattacgttattagaaatgcttcgccagaacttcggaattaccgtatcgggattagacccgttgcccaccgatgaaagcggcgttaacgtcaaactgatctattccatcattcgtaacagtatcaaaaaccaacgcaaatgggacgtggaagagcaggccatcttaggcatcttctctttcaataagttcatcatgtggaatgacattcacaataatgccaataaactggttcagaacaaaattgtttcaagcctcatcaacggaaagatagaatgggaagccgcaacagaagaaatagacgcaacggatatggacaaacaactgtcgccaacggacatcgtattgcctatcatcgccgattcttcgcaattggaagctatttacgaagctgtacacgataagacttttatcctgcacggccctccgggaacaggtaaatcgcaaacaattaccaatatcatcgccaacgcgctttacaaagggaaacgtgtcttattcgttgcggaaaaaatggctgccctctccgttgttcaaaaccgactggcagctatcggtttggctccgttctgtttggaaattcattccaacaaaacaaagaaatccgctgttatctcacaactgaaagaaacaacggaaattatcaggcagacacctcccgaagaattcaaaaaggaagcggagcgtttgctgaatttgcgggcagaactgaatcagtatattgaagccctgcataaagaatatccgttcggagtttcactatacgacgccattatccattatcaatctgtagacgtcgaaccttgttttgagattccacaaccttatctggatacattagacaaagatacatttgcgcaatgggaagaggctatcgaatcgttagtcagaaccgccaatgcgtgcggacacccttatcggcatccattaacaggcatctcgatttccgagtattcatctgccggaaaagaagaagcctcccaattacttaccgctttcattgatttattaaatatcatccggcagaagctggatgtattttccgtacttctgaaagatacggatatacacccgacacgcaaggatttccaaacgattgcctgtatcatccggagaatactcgatattccggagctgactccgggattgctgactctgccgttattgaatgaaacgctaaatgaatatcgtgaagtggtggttcatgggcaaaaacgtgatgaacaaagaaaagagatagaggcaggatttaccaaagagattctgtccatcaacgcaaagcagatggtagccgaatggaaccgggtatccgatcaatggttccttcccagatatttcggtcagcgaaaaatcaaaaaggctatcaacatctatgctttaaaaaccattgaaacagaagacatcaaaccgctactccaccggattatccggtatcaggaagaagaggacgctgttcagaaatacaccggccaactcccctctttgttcggacgattcggcaagaatgaggattggactgccattgagcagattatcaatgacatggcttctcttcactcgcatttgctgaattatgcaaaggacatagccaaggtgtcacaaatcaaacagaatttgtctgtacagctcacagaaagaattcaaacattcagagatattcacgctcactctttcaatgaactgtatcagttgtcggatacactcacagtcattgaaaagaagttgtccgacacgttgggtatatcaacagaagagctttatacctcttcagccgactggataacgattgcgctatcaaaagcccaaacctggaaagataacctcgacaaactcaaagactggtatcagtggttacaagcataccaaactctgaataaactgggaatcggatttgtcgcgacagaatataaggaaaagaatatccctaccgaccaactgacagacatcttctacaagagtttctaccaggcggttattcagtatatcattgccaaagaacccacgttggaattattcaacggcaaaattttcaacgatattattgctaaatacaaacaaatatccgccaaattcgaagaaacgaccaaaaaagaattgtttgcgcggctggcttccaacattccgtcttttactcacgaagctatccaaagttccgaagtgggcatccttcaaaagaatatccgcaacaatgctcgtggcatatccatccgcaagctgttcgatcagattcctactttattgtcgcgtatgtgtccgtgtatgctaatgagcccgctttccgtcgctcaattcattgatacggatgctgacaaattcgatttgattgtctttgacgaagcgtcacagatgcctacttatgaagcggtgggcgctattgcccgaggcaaaaacgtgattatcgtgggggacccgaaacaaatgcctcctaccagcttcttctcggtcagcaccgtagatgaagataatattgagatggaggatttggagagtattcttgacgactgccttgctttgtctatcccttccaaatatttattgtggcactatcgaagcaaacatgagagcctcatcgctttcagcaactccgaatattacgataacaaactgatgactttcccttctccggacaacattgaatcgaaagtcaggatagtcaacatcaacggttattatgataaaggcaaatcgcgccaaaaccgggcggaagctcaagcggtggtagacgaaatagccagaagattgagaagcgaggaattgagaaagaaaagtatcggtgtggtgactttcagcatcgttcagcaagccttgatagaagacttactttccgacctctttatcttccatcccgaactggaaactcttgctctggaatgtgacgaaccgttgtttatcaaaaacctggagaatgtgcagggagatgaacgggacgttattctcttttctgtgggctacggtccggatgcggaaggacgtgtcagcatgaatttcggcccattgaaccgggtaggtggcgaaagaaggttgaatgtggccgtttcccgtgcccggtatgagatgattatctattccactttaagatcggatatgattgacctgaaccggacttcctctatcggagtagccggattaaaacgtttcctcgaatatgcggagaaaggaactaggaatacaatcaacagtgtgacagcccaatcaacggaaacagcagcctccatcgagaatatcattgccgataaactgcgttcattgggatacaccgtgcatacagacatcggatgctccggttacaaaatagatataggtatcgttgacaccgaaaatacctccaactatcaattaggtattatctgcgacggcaaaaactacaaacgtaccaagaccgcacgtgaccgggaaattgtgcaaaacaatgtactgaaagcactcggctgggatatctaccggatatggactatggactggtgggaaaaaccggacgaagtaatagctgctattcaagaggctatcgcacgcaaaaagagttcaaaggttaatgcccaaacaacgacaaccaccgaaattgattctgccccaatgacagcagaaaaagaatctgtgaacaaagagtcgacagacaaagaaaaaataacaaaagaagagccaataaaagaagagtcaataaaagaagcagtaccgactgcagagagagataacaatgaaatttcatttgtactcaaagcatcacctgccacttctgaaaagcaaactgctttcgcatcttccgcacaaagcggaatacagcaaaagtaccgatcggcaaagatcactccaggcagctattcgccggaagactttttctttagtgaaagctattctatcctcacttctcaaatacggaagattatagagaatgaagctccggtcagcaaatcattactttgcaagaagattctgtctgaatggggaatcagtcgtttgggagcacgggtagaaacacagatagagacggctttagatacactaaatatctatcgcaccgaacatgaaggatttgttttctgctggaaaaacagagagcaatgtatctcctactctatttatcgtccggtttccgagcgggaagcgacagatatagctcctgaagagatagccaatgccatccgacaagtgttgacagactccattagcctgcctgtggcagatttgataaaagcatgtgcacaacaattcggctttgcccgtatgggatcgaacatagacgctgccatgcaaagaggtattcgcgaagccgtgaaaaggaattatgccaaaattgaaaacgaacgggtgacgattgcggattaaatgttggttcgagtgatcctgtctagtagattcaggtgacaggaattagatcaataccctttctccaaacgtttcagagcagcaatagaatcggatacatagctattgtccggttctattgaccgccaataacaaagctctccaatcaaccgtttcagatagacaggatcactcgaaccaatccgtcgctgatgttctgccaaacctttcgtcaggatgaaatagacattcttccggatttccctctttctggctttagggatagtcagtttcacaccggaagagatggacactcccgtgataatctttctaccatactcattgatgaaacgggtctttttatgattcggttcgaatttctcatcacgaatgatttgtttaatacggggaataatctgctctttgggaaatacatctcccgaaaaagtcaggtcatcggcataccgggtataagtcagtccgtattccgctgccaatgccgccaacttcctatccatctcataactaacgatattacttaacgacggacttgtaggcgctccctgcggcaagtgtctgtgcaaacaacacaacgttcccaatactttagatacattttccggataaccgatcttctcaaatgtctttttcactctcggactccgtatagaaaagaaaaaatcatgaatatccattttcaacacataccgctttcctaaatgaggattggcattgtcgactacagaatgaccgttccggaaacctaccgctgccggatgaatcattgttacaggtgataatatacgagaattaatagtcgcttgaatggattgcattgtttcgttaggagcagagatcatacgataccctccttttctttttctcatccaaaattcccggtaatgtacagaaacgtttcgtagtatttccttcaattgtcccgtttccattcccaacagattggcacaccagacaacagccgattcatcatacttttgaacatactgtgctcttgaaactgtcgctcccaaagcatgcctaagccaggctccatgctcccattttactttagtagtcttttcttccttactaccgtctgtcgctttccatcttttatacccctcttgttttctgcttgaggaaatcatcttataaatcagaaaaccagtgacaataagtatcgttattagaattccgtccattttgtattatgtatataaacaaagagaagagaggatgagttatttactaaaataaatttaggtatttataccttagaatttattttctaggaaaaatacctgtgcttacgaggcgactacacctctttgatgctaaattcggccctcatcctctcttatacaaagataagtataatctttcgataaaacaaccggaacggagaaaaactatcggttgaacaactcaaacgtgaacttacagcctattcctccgaatttccagttttcgctgcttacgaagactcccacgtcgaaaatatgcgtaccgatgccatatccgacttccagataaggttgaagatgcggcatagaaagtgcactgatgtaaatacgttcattctgcacataacgggtgtacttcatcagatgccggagaataaggaatggagcttcgtaggtgaaatgtccccgcacataacgacgggaggagttataccaacgtgagtcaagcacctgaaatactccgccgatttcatcattccagcctacgggaagattatggcgggagaaattggcaaagtccacaaaatacagttcatcctgattggtgaatgccccgaatccgaaacgataataaatattacgcatcaatcccatccggatttgatgctgaaggtcaaactctattctttcatattcgcccgtacttttaaatactcctttaattccccgttcataatcgaccgagaaggttggatagatagaatgcaaatttatctttcgctttccgttcatataataatagagtcccggcgtccactctatccggatgcggggagcgaaactgatataagtgttcttgaatttatccataaactccggaggcggcatcggataatcaccggtaatcacaaaacgggaaggctctacggctgttcttttatgggcagagaaccccagaccgatatccagtccgttgactatctcaactgtatggcggaagttaaaatacaagtccttgaaataatcaagatgaattaaatcgaaattaaagatactatccggcatggctttcagttcgtcgagcaccttactgctatagatacggttaccattacccacattcaaccggaagaatccccgtttctgcggccagtattcaaagtcggcattcaacgaccagtagaactctttacgcgtgaagttgtatccgagtttcggcacaatacgaagtaatttatcccctctgaaaagacggttgtaacggaaatcctgtcgataagacaaaccgttgcttccgctataactgaataaaagcggatttataaacggagagaaccgtacgcttccgatattggacaaattgaatttataatcttctaccatcaagtcccccatcgttccccaaaaggcctgactcttggatggcttttgtatggtagccgtgtcacgtctaagcgcattgtcgaaatatagttttttctcgctctcgttcaaagggatcgggcgcatgatagcaaaggtagaggcgtccgttttataagcattcgtatcacactgcaaggagaaagattccgaaagattatatttcctcttctctttcttacgtaccttcttttctttcagttcgatggatttataatctaaagaagctgtataattaccatctaccttatttccgaggaatttgaaaagggcttctacatcataacgcaccggcaggaattcatttttcttgccgacatctcccatctgaatccaacaggtaaatgttatcagctccgatcttcccgaaaaacggatttcacgaacactccagacgttgctgctaaccaccatatatccacctaccaactgatcgctcttggtacggggaataaagcggactcgataatccagattattaggatctcccatcacactgtctatctggtatttatagtatttctgtccgtttttagccagtggtgataacaagcgttcatcattcagcaaagacgaagagtagatatttacattaaagtattcgagcaagcccggcaatcccctgtttcctctcaccgttccctgggaggcttttactttctggtcgtaaatattgggagccgtataatgcaggtcactgtacgtttcaagcagatattcgcgaacacccttttgcaaacgaaacatggaaggcacataacggagaataaaattcttcttctgaatgtccatcttaccttttatatataggttcgcgcgataatcgctgactatcgtttcatacaaaggcgcaaaggtcatcacacgttctatgatggagtcggcagagatttcctgatgagtataaggattcattatataattattggctgccccctttgatataaaagagaacagacacaatatgcatcctatcaatattttatctctcaattgtcgtatctccttcattaacgtaggcaaatataaaaaagaatatcgaaaagcaatggaattaagctactaaaaagagttatcaggggaaggaagcttttcacacctgattaatataaatatatgaataaacaaaaacgactcatgtttgaatgcatgagtcgcctattaataataggagaaagattataatttctctatttcttctttcgaaatacccgtagattttatgataatatcattatccacccctaattctttcaatttacgggctgtttctcgtatacctttttgtatacctttttgttctgcaaagtccaacgtattaaaataatcgttgtaaactttccattcttcctcgtactgcattctttcctcctgggtcatattcgctttggaggctaacttttccagtcgttcaaaaacggctttacgagccttgaaaggcattcgatcaagtgtatccatgtgctttaatatataaatccagcgttcaaaatcattttcacattcatcctcttctttattaaagttcggcaattcaataaaaatctgccggaacttactattgaaaagcttacctgtatccctgtcagaaaggataacatccgttctgattttagagggtatatccttgtccatcacgaagttcatgaagaacactccgtacacagcatctaattgaaagttccaaatcccttttctcgcttgttgggtaatagccctagagagatagaaaagggcacggtctttaaagtaaggctgttcccggttctgcatttctacgataatatgttcccccgtattggttctacaatatatatcatagataagtcctcgttctgtttttacttccggctgctgttcgttgtttaggaactggatgtcggtaattacatgctctcctacgagcaaatcattcaagaagtcgattaataactccttttctacctctctgccgaataaaaacttaaagccaaaatcggtaaagggattgataaatcttcccattatttcttatatctcaattatagaacaaagatagagtttttttgttgaatagtgtcaagtatgggaggataaaataaaataaaatcaaaccaatacctaacatgaagtatatggtttgatactacgtaatatcgactctatatcacgattttaaagttgatttatgaatagacaactaaagtcgtctgttcggtcaactaaagtcagcgacttagacaactgcagtcggctgtatggtcaacggcagtcggctgataccatgttaactatttcaatctgttatacggtcatattcatcttcttatatccttccatataaggaaacgcctaagcttttgtttgaaccgggggagcttttcgttagagtgtgaagggtgtgaaaagctaaaacgaggtcattaaatcacagcaaacatctgtcatactacaacttacgagtctgtgaaacttgtggaaggcaaaagtaaacttttatttctaagttgacagagaagttgatatactttattttaccatgatttttgaaaagaatcaaaccaccgctagtttgattcataacggtacataaatgaactaaatgataattttgcggagtgccctgaaagggcttaattatatagcgtagggcaacgccctacgtaaaaacgacaatctgaatttgcgccctgaaagggcataattgtatacggttctgccctttcagggcttgtggctggtgtgtttttttcgtagggcgttgccctacactatataattaagccctttcagggcaccccaataaatatataattgtaaggctttcagcctaactgcaaaattcccatttaaccgataaattcccatttaattaagaactgcataaaaaagagaaatgcttactcttacctttttatttctccttttatttttgacaaagaagaaaattgtcgtatctttgtgatactcttcatatcaaccaggcagggaacctgcctcgttttcgtggcaggcatttttatgcctgtcctgatgcttcatatggcggtttcgtacccccgtgtggagtgttaatgcacccactgcctggttggtgaagagtagcgggaaaggcggaaccgctcttatttcatagaaaatcttcgggctcagttgtaattcttgggggattaagtttagtcaattcccttcatgcatatacctttgctagcctaaaaaggaagaagctcatatccactactcctctaaatgatgccctaaatgctttgattttagcattaaatgcttccgctgctgcatttgtactcctgttcacaaagaagttcaaaatcctttcataatggttctcaatagagtttgctactgttgtgaatgtatcgtatccatattcttcaatcttattataccatagtgccagctttgctcttgctacatccttgtcatagtttgtggaaaagatctttcccaactccaatgagtagtaatatacgtgcttaatatcttcaaactgcttgaaaagtaattctgccctgattttctgactcttggtccatttatcaggtgatttaaataataaatatctgcttctggccaataattgcctgagtgtatctccgttttcgagttcttctgctttatatacttcccccttctcttttgccgctttcatagctttattctcctcttttatcacttgccatctatatgtaatgcgcaactcttgtacagcttcgtatacaagtttttgtacatgaaacctatcaatcacctgcatggcacgtggaaagcacgttttggcaatcttttgcatgctcccggccatatccagtgtaatttctttgacctgattacgcagctcctgtggcatctttgtaagtaccgcaatgatatcatcggttttagtgccctgaattacagctataatagaacctttcctacctcgcttatctctagtgacacgccggcgtcggagttcgccttgacgccttccgagatacccttgacctgtgcgcctacgccggtctttaggttggcacttacgctgtcgaaataacctgtgtccgccataactgtcagtctttatcgttatttaactcgaaaatacaaataggcagatgcaacaatggcaatcacaatgattacaccgagccaaaatcggaatccggttggacccaataagtcaagaaagaagtttcctccccagcttccgggtctggcgtatgtccatttccagtcgaatatcagtccgacaagccaaaccaatagcagaaagattactactaagtaccccactttggggttcgcataggcatattcggttgcatcagtgaacagcccttcaagatttcgcaatatgttgttcagccattccattgtattttcctaaatttcttttatactcatacaaataattctcccagtcatctcctaacactttggtcagaacttcatttatttcatcgtcactgaccagcttagagcgtgccgaactgtttaacaggcttaatagcaggagaggataagaggagttctttatcaggtctatggaaagtttgtctgaaagtctgaaaccttccacataacattccgcagctaacgatttctcataattattttcccggcaccaaccacacagtctcaacgcttcactttgcattaggtaatcgttgcatctggagtatgcttcagcaccgcgatagtacgtctctgccgcttctttccaaagtgactctcgtacatagatggaggcctttcccaataaggtgtttccgagcaatcggcaggccaaagaggggtctaatttttcttccccgatttcagcggcttctacggctttgtcggcaaagtacatggctgtcttatagtccttatgggaaatctggtcggtatatagaattgtatatacggttacaaattggctaatccagttaatgtttttcttcacattttcgagggcaatgtcgaggcatttcttcgcaaattcctctgtttgcgttgcgttcccttttttcacactgttcatcagtttgattaatgccagcctgaaatttgaggctgccgggtcgttcttatcctcatttgccgcttgttccgcaagttgctccattgctccgtccaaatctattggcggataaatagacaccgcgtcattggaatgtttggccattagtttgccaaactgttcatggtcttttatgtcggatataccccataccatttgcttgtggaatggcagggcaagagccttttcaaaccattcacgacatccgtcatagtcgtatgtgttctttaggttaaagacaaaactgcatttcatatcagtcccttttacaagggattctgtcagcttgttgaagttggcaactgcgacggaggcatcgttttccgctacttccggtttataatcagctatccaatcaacacgttcaaaaacaatttcttcgggtttctttgaattgttccaatattctacctgttgtgcaatataccctacaacatcttttgagaaatcggttctggaactgaacggaagttctatgacgaacaccatatcttcctcttcgctatcaagggcaagcatatagtcatagaaagcatcaagcatactttcgtctcccggattgatgacgatacgaatcaacttaaccggtttcctgactgcatcttcccattggtagagcatcttatctgctatttgttgtatggcattgctcatatgctgttaattcaatttgacaattgttccggctacggctgtggttccggaagaatctatcgtagcctttgttgtaccgctgactgtagcactgctactgccggatgctgtaaaatctgtactggagatattataattactgcttgctgtacaatcaatattttctgctgactgcgcaatattggcaccggcggactctgttatgtccttttccgcattagatgatatattgccttcgctatcaatcattattttgttttctccaacacacaaggtgatgcttttagaggcagatattgtgatatttccttctccgtctgccgtatagctgttgccttccttgtctttcatcataacgcttcctttttcatcatcaagcgttatggtacaaccgctgcgggtagtcagactttttgttttgtttgaactgccgccaccggtacctgactttccatggaataagctgccaagcacaaacggacggttcgggtcgtcatatctgaatgccaccatgacttggtctcccttttcgggtatgaatacaaatcctctgtttgtggccaccttgtcgcttgtgcctgcgtcaggagtgagtacccgtatccacgaggtttgcatcggaccggtctgccagttcatcttgacttggacacgacctaactttttcgggtcctcgttgctgacaactacggcctgctgtgtatgcgcgacaggcagaggcacatctgggcatggaagggtgggaatagaggacggaagtgcggtgaaatagttctggtaactgtcacccatgccggctacgtgggttatttccgtaatgatataggtgccgatactgttcttgacgaatattttgattccggaatgaatagcggtgtggatatctatgatactgcccaccgtgagggtatagcagtcgctctctccggtgacaaaacaggatgcggcggtgtcgccttgctgcttgcgctggaagtaggcatcaagctcacccttgttggtgatgcgtggttccgaacgttgtacggcgggagcggtaaacagtgccaatgacgagtcaaaggccgcttgtcccaatgtgttctgtccggctgcggcatcaggggactggccgttataggtctggtcgttcaccgaatggtaagaacttccctttattggtcgggcaagtgcctgcgagcagacgtcgagcacggatagttcctcgccgtatatcagcttggtcgttgagccgggctgtggcttcccgaaaacaaggttctgtccgtcgtaatagagccattcctgatattggcgggcaagccgttgtatgaatccgaagttggtttcctcgtactggcattcgtattccaacttcgatttcgtttccggattgacaagagcttgcactcctgccttatctgtaagttccttaacgatgtcagacaaggacttgttgcaccatgaggcacaagtgtggtccgactccagtaggaatgttgacgaatatcccgtcacttttatatttccgtgtgtcccaccagcacgatgaagtcctaccatggtggcgatgccgatgaaaatagtgccgccgaagtccatgattacttttttcccaatccagtcctttgacacattcggtatttccacaccataaatttctacggcctggatatccagcgttatctcaaaatagtggtgctcattaatgctctgtttaagcatcagttttacaaacgacggcatggggatgccggctatttccaatgtgacttttttttgttccagcatggcggcattatatttgacggtttatatccaaattgccaaagccgcccggcggaagtccgtcggacggcctgacaaatgttttgattttaggatttacctatgtacgccgatttatttcttcggccaacggttgtcaagagctgcgctgccgacagtgatttcttcagcggagaacgtgatggtgattgtcataggcacatcgttattcgcgtccagagtttccgagtagtgaacgatgtatgcgttcttgaactggatttccttcatcttggcgtcctcctccgttttcttatagataatcttaccttctacgggtttgaaagcactgttcagcattgactcgataacagaagtgtcttctgttgattcgatagttacttttactctaccgcccaatacgcttgaagagggcatacctttagagtccgtgttacgactgaactcatagtttgaataaaggacgtcaaattccttgttgttaagttctaatgatgctctaaatgccataattcgttggatttaatgagttaaacttaatttttactgcggtctctccgtccttgcgccctaaccggtatagatgcaaaaaagagaaaacctcaaaaacgattttttgaaatttcctctcagcctccggatgactcagttttattgtgggaaaaagagaagaaaataaaacatcatctttgatgtgagcaaatataagtgcttatcttcatttctccaaattttttagcgcgtttttttggctgttgttttcattttaacacgttttaaactaatattcgtgtataaagccactgtcctatatgattaggaatgtaccccgttgatgatgtgtctctattgaattgattcccagtattgtaatggcactttcagaagacgtttcatcagggatggacgtacccgtcggaacgaaaactactgccggaatgcggaaaaaacggtatccaccgcatgaaagtggcagataccgttggcagattgactatgtagtctgaatctttgcgtatatcctaattcttgcgcccatatcggcagatgagcaatgaacttaataccaggagtgcaagggcaatcatccatgtgtagattttccgttccttttccaaatgttcgatgtccgccgcttgttgtttggagcaagttgtcagtatattaatctgggattgttgtgccttgcagatatccataagttcagcattaatccgttgctgtgtttccagcgaagtttggatgttcttgaagttacggttggtcgtatatgcgtcgcggatatatccgggtgtgcttacctgtaacgacggaacctgtatgctgtccggaaggtatgtcagttctgcattattgcgccgctctgttgcgaagctgttgaacaggagtatgccgacgagtgtgccgctaatcagaaaggctattaacgctatgatggcaaatattgtgtttgacggtttcgcaacaggtggttggtactctcgttcaagccatggatgatggttcatcgtgtgaggcggtatggatgtttcatactccacagtccggacttcggcattttcttcggtctcttttttctcaagggccttgcgtcttgatatatccataaattcgcgcttggcaatctggtatttatctgcttgataaatgacaaggtcgttttttaccagccagtcaagaacgtccttgacactccgttctgataccttgaggttgctgatgctccaaaatatctctgcacaagatacccatattggtttctggaggcacttctgatacaagatttcaagtatctctgcctgtagttgttctcttgttggttccatttatttacagtattaattgtttcggaataaaataatatttcttgccggctatgaatacgggcctgaaaaggttgcgttgatacatatcttccagtcttttcatctttgaaatcagggctgtatagccactgttaaagtccgtcagctcaacctttcttttcttcagtttcttcacctttgttgaatttaaaaggctgtcattggccatgactcccgtcttataatagaagatttgagccagatatggatttctgggcaatacttttcgatagaaacttctgtttatgcttttcttttgccgcttgaattgcttgcgaagcactcttaactcctttttccctatgttatctgaaaactccgggagcagtcccctgtagctttgcagcagtcccatcacttccctgtcatcgagtagatacccatattcgtacccgttcattatactgtccgctacggaggcctttatatagtaggtgtcattcacgctatttctatctatatcgtcaaggctcgtactgtcaggattttccgtatgatagaatatatgcgtcaattcggatgtgggacggcttcttaagacacctatatttcgctcataatctttaagcgagtacaacagtaggctgtccgtctcgaaagattgctgaaacacggaatccaaggctgtttccaaagcgttgctttccagcctgtttcgacctttagggaacaagattcctcctaccgtaaggctgttgtatggggcatcatacaggtataagttggcatccgtagcttctatgttcttgaacagttccgtctttaccagtctgttgtctgcgatataattggatatatggtctatgtatttcgtagaatggctgtccagaatggatttggcctgcaataggaagtcctgatacgcagtacctgacgctctgtctatctgggcaaacagaagccttgccggttgggttgccagccacgagagttgttgttcgtgcaaggataaagtttgctttgaccctaaaatgatgaatacattgttgctgaaacggctttcgttatcatagcaggagatttgtttgatagccccgccaaaaccgtaaaacgatgattgttcctcttgctcgttctttcgcttggaagaaatggattgtttgatatagtcgagccaggctgaaaagtccttggtgggggccaaatgtctgttttctccgttgaaggatatgcaagttgccgaaaatgtgtagtcatatccgggcttcattttcagctttaggttctgtagtacattgatatatggggatagataaggtaggtcggcatcattgaacagtacatgtatgttcacgtttttgttttccgcttccatctttcggacatcggaaaccatgatgtctccacctttgatattgataatcttattccagttcttgtcccagacggatagaggatagttcagccggatattcccgtccgttataggccctgccggatttccatccaagttgaacaatatcgtaccctgaatattcgcattatgtagtgccaacgtatcgggatacatcaggttgacggcacataacaaagaatcacggtatcgtgaataatcaacatgatacacttcattctggccgacttctgcaagaaggtcagcgggaatccatcctaagaagcgtttggtactgtctgacaatgcgggtgcattggaaatcaatgcggatttgccgctcttgtccagcttatataggtaaacaacctctccgctgacaactaccgcatccgttgttgttttcagaaacggctctccgtatattttcagggtatctccattgaagaattgatggatatcgaacagcttgttaatgctgtttatgcctatacggtaccttattggctggttgttgcggggattgatataggcatggtcgtacatcagtatattttccgatggtatccatccggcataattgactttacggggttctttaaagtgcctcttgctgttatacaggaaacctataatcgacttgggcttgcctgtaatgtcagggtcggcctgaacgagtttgtaggttccgttcttttcacctactatgtaatagggtgtaccaatcccgtgtgaagaccgcttacgctggaaatacgggtcttcataactttgatttccggtcctgtccgaatagacaattctgtttgtcttgcttttctttgttttgacaggtgcttccgtggattccggataattgaatatatccctatccattatttgtatcctgtcgcggatggacacttgggcagatacgttgcacgcaagagtcatcatcacggccacagaaaacagatttcgtatgagattcagttgtttcatttttcaatataactttgtgtcacatggatggacttgacgcaattcaaatcgtcaatcttcacatcatcaatactcacacgctttttcctgttgctctcaagaaaatgcagtccttggcaatagccgttgaagtcattgtatttttcatcattgatgatgaccactacctggtctgcatcaatgcaaaaatattttttacggatataatttgtatgttcgtaatagaccgacttttgtgagactttggcgtcagctatggcttgcaggtgtttttttatatcattctgtaccagtgccaacgaatctaccgtgaccagttcctctgctttttcaaagcgtgggagaatggttatacggtgctttaccggatatttcgtcgtattggtttgtaatgagatggtgtattctcccggaatatcatacgaatatacgacttgctgctcgtatgcgtccacagtaccgctttcgccaaattcccatagccatgtgtccatgccatagccttctgccgaaaagaccagctcttcgccttgataaccctctgacactccatttatacggggtatggaatcaatggcctcatgctccagtcctgagataaccttgatatacttgtttacggagtgttttccgtctattttcaaagtaataagatatttgccggccttacgataagtgtatgacacatccgtatttctcatcagtgtatcgccgtttcccatttcccaaatgagctgcttgcctttaatcgccgccgtatcgttgactaacagctccaaccgctcattgacctcataatgaaaattatcattggtgtcatacacataaaagtcaatattggcaaggtgcgacttcgaaggcaggaacaagaacaaaaggatacctgccatggcaaccagtcccaatatgatgattgttatagttttcttattatccatcgcgaatgttttataaattggctttacattcttccaaatcccgctcaatcagtgcattgttgtgtaccagactgttcaattcctctttgatgtcgaattggcatttaagcactctggaggacaacacgccgaaaaggaatttcgtattcatattattttccttgtatatatgctgcaattggtaaatcccatccttcacttcgtccatcttttgtacctgatggatgttgaagtccaaagagtcgatttcattccagatgttctgcgcttgctgcatatgtgtatgctggatttcaaaaatgcgctcggaatggttgatgtcgtttatcagttccgaactgtcctctgtcggtacgttgagtatataccggcaaagtatgatataaattgcggctactgagaaaatcagcagcaggagaaaacggatgtttccccatagcacttcgtcttttgtcatggcttcgtcagtttattcttggttaattcctgatatttgattctacacttttcaagttgctccatgttgctttcacgctgtttgctttcgcggtcaaggtcatccatggatgactggatgacacgaatctgttcaagcatggctttatacacttcgtacttgcttttatcggcctgcatcgcaatgtcattttccatcaataaccgttttttggttatcagtttttgcatatgcttgtgttcactcgaatttcgccgcttggtcttcagattgttcaggtcccggaacaattcttctatctggaagttaagttctgcctgtttcttgaacacattgtcatattcggccttcttgctttcaagaagggatattcccttttgtgcagtcacaatcgttacgacacctccggttgtggtaacaatcagtgcgatagcgaataccaaagtaaatcggagtttcgctttcaaacgagcttttttgttttctgcttccatatttgctatgatttaatcgctcaacctataaacgaccatgaccgtttcttttgagcttctattgtttcgtgactttcgtctcctactataatattctcacgaaccattccgatgtattccagttcactcattttgtggaacatattgctgagcagtgtcacaagtgcccctgccgtctgcaatgattggtttatattggtatggtcatacataagtttggttacgctctctatcttcgtgataaattcagagggcgtgacattggtccactcatagaagtattggagcaattgttctctttccgtttcggaaagactttgaagagcggagttcagaccgtttgcaagttcgttcacggcctgcacaagatatatcggcggttgctctaaggcaatttgctcgataaagaagattcttgagttgtaaaaggcagagaaagccttacacagctcaaatgtgttgttggcaagcgtatctctacgcttgtcggcaacattcctgctgtaaatgagtttcacgtcttcttttatagactgtagggtacgtgccaattgggaaatgaatgttttaatcccatcgtggcaagcggaatgttgtaccggcggaatatattgatgattgattttataggtattcccttgtctgcatacctctgccaccagcaaaaaattctggctgtagaacgatttgttgacttggttcttggggacgatatggagttttatgctcggcaagacatacgggtgatgcaaaggcacctcttccgggtccggttcaccgacaggtatcaagtgatacggatctacggatattagtaccatatactcgctgtcttcggcttgcaggccggattctgaaatggttgcactgggtttctcatccccgtataaaccgtcgtaataaacgatgggcagaccgcctttggtgattgcgttacaacttttcaggcggacacagagagtggacatggtatcacctgaaatctcaatttcaagattgtcacctatcccttcaagaacctctccaaggccatagttataactggtcaagctccttcctgcttcgcggttgagagcttccgtttggctatactggtttgcaaagaaatgcttgctggtcagcttcagaccattgacccagtttacaggcaaatatgttagtgttttcatatattatgatgtttttgtttctacttgtactcgccggatatatatcgtttggttattcttaatcttattgccctcactggtcagagtggggtcaagtattcttatgaacaacgggaagttaaaccattttgaggtatagaacatccatccgatttgcatatcttccttttctgtttcaatcttgttttgggggaaacgcctgttttggtcttcgataacccaattgaaccagtttccaagagatatttcattgggcagtcggacaaccagcgaagcgtatgtcgggtcttttatattccgtttaatcttgactttgaccgttcggaaaccgaagttgtctatgttgtcccaatatttccggtcaaaggttccatagctcaattcccatggggtgtatatcggatgcgggatgtccaggaacagggttctgctgtacataatcagatacgggattgcaaaccacaggatatttgttgtgttccatagcgaataaggcagcttgcttatcagttcaaacagcagatagtagcaccatccgcctaaagcgcatatcgtggttagagtgagaatgaccgctgttcgggaactgccaataccgattgctccgaacaaatcggaggttgacagtttgcagaacaacgccccaaggaggatataggacagtatcgtgaatgtcaagcctccccagacgtattcattttttaggaaaccgaacaggcagggtaaagcgacggcaatggaagccagaagaatgaatatgattaatttcttcaggctaagtttgctcttgatcgtttttattccggtcaagacaaatatcatcacggctacaaataatggagccaataaataacgtgcaaagaaatatagcaatatcttcatattattagatttttcataagttcatattatatcctaatcggttttctccgagtataaaatccgtttctccacataccagataatcaacttcgatatttcttgttgaaaggatgaaaaattcaagtatccggcggacattggatagatgcgtttttacctcctcatagtcatctgtcggagtatcaaggatgattgtcgccgtcaaatcatcggtttcacttatcattagaccattaagacctaatgtctgtccgatacatccggaaccgactgaaaggtaaaccgtttcatcaatctcatggacttccagtcgcagtttcaccttcaatcccaaaacgataaggaacagttgctcgatagcgggcaggttctctttataccgttctgcattgcagaggaataggaacagcttatatttctgatggggagtaatggatagctcgatattttccattacttcaatcatcttgatgaagttcttcttggagtccgggtcggaaaagaaattcagatggcggttattgatacggaccttttctttgaaaaattcagtatcaaagggtgcaaagaattgaatcagctctttgtcctgtttttcattggctcggatggcttcgactatctccttattgctcatgcccggtgtgctaagcaccaagggatgaaatagtaattccggcaattgatggtagatgctgtttcttgccagattcagcaatatatattctttgccggcatttgtcgttgcgacatgctgttccgaaacgcttaatacatctctggatttcacacgactgttcataccatggcaattaaccatagtatggtccaacagccgccggtcaagaataaattggagttcatcataaaagatttctgcgacgaaatttattgcctgacttcgttggatgctttccaagggtttcttttgcgctaacattgttcccatatcagttctccgtttcgatagtttatgacgatgttgtcacccggcctgatttgctcagagacaatcagacgagatacggacttcttgatataagttcttatgactcctgcaatcggacgtgcgccgtattttggagaataccctttgtttgccagatgttgcaatgcttcatccgacaaattcaactggatgtttttctgtttcatcagttgttcttgcaatcttccaaaatggaggttgaatatctgtttggcgacattttcatctattggagcaaacggaaccacctcggtaagacgtcccaaaaactcaggtcggaaatactgtgccataacctcgatgagctttccggaatcaggagtatgcccggattgtatttgttccacaatccactggcttccgatattggaagtgaaaatgattatggaattagagaaatctccttcccggcccagtttatcatgtattttgccttcatccatcatttgcaggaaaacatcataaacactgctatgggctttctcaatctcatcgaacaatactaccgaataaggtttctgcctgatttgagtgaccagcagaccgccttcctcatatcctacatatcccggaggtgcaccatacagtaatgcagccgaatgttcttccttgaactcggacatgtcaaatctgatcatggctgattcgtcatcaaacaataactcggccagtgattttgtgagttctgtttttcccgttccggtaggaccaaggaagaagaatgaacctataggcttcttggggtcgctcagtccgctgcgtgattctataatggcatctgataaagtcgtaatagcccggtcctgtcctttgacccgctcttgcaatttgctctcgatgctcaaaagccggtccttctcgcgggcttgtatctttccgataggtatattggtgcattccgctacaatcgcttctatttccgaagagcgtatctcttcaatggactggtcggatagcatctttagctctttgatgatgcccgacaaacgtcctgcttttatcgtaatgtcatcttctttgtcccacacatagttgtctgacagtttggtagtcaacacgacactgattttgctgaacacagagcggtacagcaagtacagtggtccttcagatattttttcgtcgagactccttattttctcaaaatccgtttccaaatcagatatactggctcgtgcgttcttattgcatagtcggacggcagcggcggttcggtcaagcaggtcgatggcggcagatggcaggcttcgctccttaaaatatcgtttggagagtgcgattgagtctttaatacacgcatctgagattctcagctcgtaatagttttcaatcctttttttatgtaattgtatggcattttccagtgtagtcgtatccagttcttcaatctttatgatgtcaagacgcccttctatcggatgtttttcgatgttcttccggtaagagtcgttcgtgagtgtgagaacaagatttgcggctccctcgctgatttgcgcacttaatatgttgacaagcgtggatgccttgcctgatgcgctgttctccaaaagaacctgtaaatcatcaatcaccagcacagcttgttccaattggttgagcttgtgcatcagattgacaactttttgtgctatctccgtttcagacgaggttgatgcgagcaattttgccgtattgagtccgacaatagatatttgctttaacatctcgtcttcattctcacaaatatctttgacaaaggcgttgatgatggaactctttccgataccggattcaccgacaatcagtatccccttgttctctgatcgttcgaggcattctaaaatagtacggacctctttttccctaccgacgacgaagccaccggcattgatggtttcttggtttttcaggttgtcggcataaggaacgcttgctgttatctgcatttcctctccctgataagaatacaacggggtaagggcattgtagtgggacaatatgtcattttccgaaatatccagcatctctatctgctgatgcgaatacacgacaccttcacgtaatatggcggtaaacacacagatggagtctatggaatccgctcctaatttaattttagaccgttcggactcatccaagactttcgacagttcttcgtcaggttccacttcttctgtggaagtgccactggacctatacatttcgcgatgggtgtcaaaccattccattatgtagccgacatccttctgcatcgaggataaaatttcttttaggcccgtgttttctgcaaacatggccatgacaagatgtgacacgccgaacgtgttatgcttgtcttgaagtgccattcctcttgctatcttaagggcagacaccaaacttggactataattgctatcattcatacgaatttgattttatagtttgaattacatacagagcgttcagtcaaatctttttcaagataatgggccaattcttccagattgggaatttcatctttatcaaattgtccaagttttatcttgatctctgtcactctgattaatccttttttgctgtcaggagatatagccacgccattgccgacttcgactgattcaacatattttcccagcttgtgcaacaggtagcttttgatgtcttctttagatataatccgttcccgggacaacagaccgtaccttaaactatttataagttcctgttcgccatcatgcgttgttcctccttgcatacaagtgcgcaacatgatgcccgaagcatcatatttttctatgttgaattgttgtatcagtgtgcgttcgttgaaaccgttcgccagagatccggaagttacccaatattttatctcggcattggtcgcatctttttgggggacacttaaaacaaaggcttttattttgttatctccttttagtgtggcctccaatcctctctctatatcatttatcttgttgaacaactctttgagctgcgtcgaaagtgcatccggattcattgaagcgaaagcactcccgtcttctttcattaattgtaatacttttgaaattaatgagcgggcactgtccgaatcaaatcgttcaaggtcgccaaaatacaggctgaatatacctgttggattttcttcatactggttcagccggtttacatattcccggcctttgttgtcttggaacgagcgtatgttcaagaattgtgtacggctcggacatttcagggggataatccgtccggtggaacggaaattatgctgtttgtaaacgatttgtctgtttacaaccggaaatgtgttcaaatatacttccagattttcaagactttctttcgtgaatatttccggaaaggctatcttgacccaaaagagactctcagagtcatccgggatctcacagtcggacgcataaccgggaaacatttctcggtaggtatgtttctctttggaagcgtttcttatattcacattaaaatataggtcactataaaaatctcggatttcatcaaagtagtgtgcattactatatggatcttcaacatgaaggcctgtttttgcattcagcaggtttccagtgcagtcatagaagaaagccatattcataaacggaagcagccccgtgtcggaaggcttgatgcaaaacattacagagtccattttttgcaggacttctttagacacatccatcccgacccagacgcaataatccgctatccggtttttagggtcaaggaagcgtgttggagtgctaaagccatcggttgaatgccttatgctatcgttatatgcgattgctctgacttttgcgtcaaccagtttataggaaaacaaaggggttataaagacttgaatatcacctttgccaaatatgttcttctctgcataaaaatgatcttcggcatcaagctcgcaacattccccatgattgggggtaatagtcataagcgcatgggccggctttggcagcgaccatttgtttcctatgagtattctggacagacggtgaagtatccgtgagtcggactgctctatttcttgatgcagtttgttggactcatgggcaaaaacttcaagcagcaaatctatcacggggtccatatcgcgtatatcggatacaccccagaactccatagcctgctttaatattcgttcctttattgcaatttgtttcttgtctgccatagttcgattattgtgataaagggcttatatataatgaggtattgaaattgaatttctcgttggttctatccattgttccggtcacggttatttgtgcctttcttcggatatgagataccttatctatattttcttcttctatttccaaaagagtgacgttcacatctacattccgtaacctcttttcatatttctctatcgtttttattaaggagttcttcactccttcctcccaatcgctgattttcacaagttggttgaactcaaggtcccatatcatggaaccaaagtcttctcgcccgataacttccccatgatgagaaagaatcagtagcatgatgtgttgggctatcgattcctgataggaacacctttgcaatttcttggcgacagccgattgcaattgtaatggcattttcaggtaagtcatactattcttttctttattctatttcgcaaatatactattttcctcattagatgccaataaaatacccctaaaaatttgacggtttcagaaataattcatatattgcgcacggtcataaaaccaagagagagctataaaaaaagtatgatattaaaaagtaaatgctatggcaatctacaattatggaattggaggcaacgaagtaaaagtcgatgcgaacgaatccatcgcggaaatcccctccaaccgaactttgatagttcaaaagctgacagatgaagctcctgcggctccggaaagtgtgtatggtttggaaaccattgaagatgtgttccaacgttttgaaccaacagttgacttgcgccacgtggatgcggaaggtaatgaaatcaaggaaatcatgacattcaccggactcggagacttcggggctaagaagattaaagagaaaagtgatttcttgagtaaacttgatattgagaaagagcagggtgtccgaataactcgccagcttacttccaaccgcgctttacagaaagcacttgaaaacccggaagtcaaaaatgccattatggacgtgattgaatcatcaatcgaggagattctggcaaatcaaaagaaagtagaactttaatcttttactaagatgaagcaggaaactcaacaacagacagccagtacgacaacctcacagaaagtcgtatcacaacaggcgcaaaagtcatctgcatcggcaatagacaagctcaaagaatttggtggcttcgcttttcttgaaaatatcatagatggatattccaatcttaatccggcacgaaaggcccgtcgcaacatcttcctcacggatgaacagtgggaaaatgaacgtaaggccttggtgaatcgcttaagcgtatggctcaaactcctgcgtgagaatgacactgccgaacaaatgcgggacaaggccaaggaaaccgcagaaaatgccgagaaccttcttaatcataacttgaagaatgctcttgccagaacacgggaactcgaaagcgcataccgcactattgcgctcttttataagaacacggaaagtgataaggtgaagaatgtcaccattgtcaatgcgaccatggagcagcttcaggatttggacaataccatttttgctgaccacatcagcaatgaactcaaacagaattttgaccgtcttgacctgcgtcgcaactactcgttgcttgtcgttcccggatatataggttcaaatgccattttggacaagtggtccaagattgcatacgagaacaaggcttttcttgttacagacttccaaaaccttgaaactccggacgatgtagtagatatattcttcaatgccaatcatacgggtggagatgtattcaaatcgaatactataatgacctgtaactggttgcttggtcgtcaaagagaggaaagcgttggagaagaagaaaacctttatattccgccatcttcttcacttgccgggaaaatatacaaaaccttaatgtctcaggtagtagccggtaagaaatttggtggacttaatgaagtagaaagtgtacgcttcgaccttcgcaagagtgagatttccgaacttgaacgtatgggtcttgtgccgatggtgaacgagtacagcaaggttatggctttctctgccaagacattatttaatggagataaccttggcttgcagacctactccgtagttcgtgtattcgactatataacgaaagtgctgattgacttcctgaaccgtcgggcatttgagaattggactactcgcacggaagctgatttacgtggtcaggttgtgaaattcctcgatagtgtaatgggaccgaacaaactcatcgaacgcttcaaggttatgaagattgaacaagacccgaatcagaaagaccatgtgcttcttgatatccacgtcacaccgtatttcccggcaaaaagcttcgtgatacagcttgccggtcataaaggcgataatccggaagatgctatttgggaaagcgcatatcgtcaagaataaattggataattttgaatttacagatgggcataatgtatgtccatctgtaaatcatttattcacttatatgaataaagaaaagaaagagtatcggataagaagtaggtgtccgtaatcagatgagtatcctcaatagcgcggcgaaatcggacaagctcttgcacactttaatgtacaagtgaacgagggttaagccaaaggagccatactcttttagtctcatgctataccgtatattcacagaaaaagcattattatgcagcttgccagtctaaggattggttgctctgaaggtacaatactggacggtaaatatcatcaagaataagtaaaacattaacgagttgtatatttgccactttagacaaatatttctcgttcatataataaaaaaggtctgaaatggaaattactttgcagcaatttgaggcaatgtgccaaaatcgacaattacataatggttatgttgaaggtttagggtgtgtattttggcggtctcgctatgtcatatcatctgataccacatctactgaatcattttccacacctttctatgaattggtagtgataaaggatgagaaaaatatcgaaagtggattgcaaccattagaggggctgatagacaagggaactactgctttgtctttatatggtattgcaaattcttttgagcaattatcccaaaaacctattgtcattggagaaaagtatattcagataaacagacaaggtactttggttcgtaatcccaatagagtatatacaacaaaaggtgaagttgcgaaaggtgtaggtaggaaaatctatattgcagggcttgttattgatacagcgttatggatttctggtaaacagactttttccgaggcggcattaaatatgggagtgaacacgggcatttatattatcggttcttatttccctccagttggaattgctcttggtattttgtggttcataaccagtgtctcaaaacgtccatatatttccccaccaagttatgaagaaatacatggcactattactcccgcagatgcaacaagagttgaacgtccttattattgtgaaccaatgagagtcaggcccaatcataaaaaacatatattaagacaaggaaaatgataccataacacaatgaatataaaacgtaatacatcctctttcaaagaaaaaaatggagtttcatttttcgataatatattttattggatttggactactgtaccgtcaaagggatttcctgaccgttcttttgtagttgttacggtatgtcaattttcttatgtgttgctttttgtttctattttgttgactctatttgatgaccaagttcaactttgcatatatgacaaaccagaacctatagctattcccatgcttatattgttgataatattatcttttatcaatttaaaaatatatgatgagcaaaaatatcaaaaattggaacatgactttagactgatgtctgttccacaaagaaaaaaacataaaaatattttttttcttttcttgttgactaccatattagttatattagttgatataatgcttctttattcttataattctcatatgaataatctaacatgaagttttcttcgtgtagttagtgctcttttttcaaattggagatttttcccataatatagcaataaataaacaatttaatacgtctattatttcagaaaatgacagtgaaataatcatcaattccaaaaaacaaaaaaaatatgaagatgataagaagagtttttgcagttttatcggcagtgttttgtttggtaagttgtaataatgaatctaaacgaatgcccatttatgttgagccgtggtataattctgaacctttgacaattcaagtggggaagtttagcgatgtgctgaaaagtgaagatgtaaaaaaactgcaaagcacggctgatgtaattcgagccgaaatagataatactcccattgaaacgctctatgtattggcgattagattttatgatttagggcaaaaagatgatgccgtttattggttttatacagcacagttccgccgaaatctttacgcccgtatgatagaaaatgtagggggtgtaggagaacctgcatttgaatgtcgtcaggcgcaattggcattcaataaactatccgggaaatggattaacggttatgcaggtggtgtaccggataaatggcttgaaattcttgctcaagttattaatgaaggtcgcaaaagcggctatgtcggattggcttatcctaaacttacctttaagccagaaacagaacaagctgcggtagccgaagatatagcaaaagaattatctgaactgcgacaatatattatagataatcgggaagaaatggcacaagcccgtaaagaaaatggaatagaagggaaatattgattgaatctgaaaataggatatagataaacgaccataagatgaatataaactggtgaataataattcctattgttcttttattaatttatgctttagaattggctaataaattaatgaagatgaatatggaaaaagcaatcatggttgtagtcagcttattactttatatatcagcatgttgtgccaatgtgtttgctgacagtgatagaaatcccggatgggcatatttgctcggaggatggattgaaatctttttggtaaaatggccttcaaaacttttttatatggcatggctggctaatatcacttatggattttctattaatatgtacttgtcggggaagaacacttcattattatatgtacttattatagtcagtatattattggctatgcttccgttgttttttaataatccgacattcgtagacccggaacggggcattgaaagcactcttggagtttttcatttatcaataggttattatctttggataggtagctttttgactttgttattaggtgaaatcgtattgtttttccaaaaataaaatgaatagatttttaactatatatgtctttttgctattgtgtggcacggcttccgcacaacaaataatagaatggaataatttacagactataacggataacgcacggcgcacggtctattatgaaaaaggcagtaaacaaccgttgcagggagaataccgcattgtacgagggcttgacgaggagcgtgttaaactttccgatggcataataaacggcgattattttcgctatcgtgatggggtactgcgtgaatcgggcatatatgccaaaggtaagcgtaacggcacattcacggagtattaccaagacggcgttactctccgaaaggaaacacccatgcagcaaggcaagatagacggaactgtaaagacctattttcgtaacggcaaaatagaaactgaaaaggagtatagacagagtgtggaaagcggacgggaacgccgctttgacagcaagacgggtgagcagatttttgaatctcattatatagacggcaaaaaagagggtgaggaatgggaaatcttcgagaatgggcgcacgcttcgtagcaggactacacgacactaccgtaacggaaaacttgacggctcttatcgtgtggaatcaacacgggacggaaaaccctatataaccatcgagggacaatacaccgacggcgagaaatcgggacgttggaaacagtacaacgccaccgatgacacaacccatgaatgggatgaatgattttcttttttcgcaagttgattttataaaattgccaccgaaagttcgtactttcggaaaaagatgttatatttgtaaatgaaagagttatttgacagcatagcaacgcaaaacgctgaaattcgcactattgctaaatcgttatttctatttctcaaataattcgctaaaagtttatttctcaatcggttaagtcaaaccgagaaaaatctaaaataaaaatatttccttttactgatttttgcagatttatttttataacatactatataatagtgaaacagaaagaaaagaaagctcgaaataggaggacaaatgaacaaatagacaaggatgtaatatccgaacttgaaaagcttgtagctgaatatggttttggcaatgtcaatttgagtgcattgatgaaagctgcaaacatagaagccaatgtgttttatagaagatacggctcaatggaaaacctttacgacaggcttgctaagcagtatgatttctggatcaatgatgctattgacgtttccagcctgaacatatttggacctaaaaagttttttgcggaaacattcaaaaccctttataggagcttgtctgataacactgtaatgcaaaagttgttgctttatgaaatgtcggttatcaatgaaacgacaaagagaacagcagaaacacgggatattatgaatttaaatttgattgcgtattatgacaatctgtttaaaccggcgaaaatcaatattaaggctattatggcaaatctgattggcggaatttattatctgatacttcataggagatgcgcgaaaacctgtacaatagattttaatactcaggaaggggaaaaggtcttttttgaatggatagactttctaacagatgtcatttttgacaaactggaagcgtatgaaaggaacagaaaagcagctcaagaaatgttatctgacggtataagtgaatttaaaatatgcaaatacatgggtatcaataaaaatgacttgagaatactgctttcaaaataaccatagaaatccacgagagctttcaacagagtctaaaaagtacatataagtgattatggacttaatagtttaatcagatcattggagcaagggatatttgacgttagctgttgtaggctcttttataatttttttctatatatccctttgtataaggactgacagcctgctacaagaaaaatctgacacgctttgtgtagcgtgttacataaagtgcgtcaagttgttttttcaaaggacaaacacgaacagacttgaaattgcggataatgatataagtatatcactattcacagtttcaaggtagtctttgtatcttagtccggctgtccgttctccttttttattattccctgctttagcgtttttctattccttttttatatacttccatttatcgctttctgctgccgtgcaacctgccgtggattgaatttttccgcaaaggtaatcgccagtcccagtcgtgtcaatgccggcattctgccgcgagtgaagtgcaaaaatcttcctctccgctggtgagcgtatttttcctcttcagccttgccagattgttcctgccacctttggatgcagaaaaaatcatcccggaggtcgcaaacaggccgaatagagggaaaataaaaaatattataaactaaggtaacggtaggactaaccacctgccacaaaaagaatttattatgttatacgttcacacaattggtcgcattggcaaggattgccaggttattactggaacacacggttcattcatcgcatttgatatggcggtagatgactattcacatggaaacagcgtcactacttgggtaagggtacggagtaagaaagagaaccacattcgactatccgaatacctgaccaaaggacggttactgctcattgagggaacactgtcggcttcacagtggaaggataaggatgaaaactgccagattcaactatccattacggcagacacattggagttcatcaataccggaaagcgggaggaagcaacttcagaagcaggtagtcagacggataccacaagcgatgtacctgtaccatcggtagctatgccacaagagaacaaggaagacttaccgttctgatgatgtgcatatagtgttgataaacaacatatactaaatgtagtagttactaattatagtaaagtagtgaattacctattagcgaaagtagtatttactacatttagtttgttagtattttagtatagtagtaaatactataatactaaaatactctttttagcaaaatagtatatactaattatagtatttactaagaatagtattatctttgtattgcatataaagacatcaagttatggcaaaaattatagctgttttgaatcacaagggtggggttggcaaaacgactaccaccatcaaccttgccgctgctttgcggcagaagaaaaagcgtgtactggctatcgacatggacggtcaggcaaatctcacagaatcatgtggtctctccattgaggaggagcagacggtgtatggggcaatgagaggtgaatatcccttaccggttatcgaattggagaacggacttgctgttgtgccgtcctgtctcgacctgtcggcggcagaatccgaactgataaacgagccgggacgtgagttgatactgaaaggtttgattgcaaagttgcttgacagtcggaagtttgactacatcctgattgattgtccgccctcactgggtttgctgacactcaacgcccttaccacagcggactttctgattattccggtacaggcacaattcctcgctatgcgcggaatggcgaagattacaagcgtgattgagattgttaaggaacgcctgaacccgaacctgagtattggcggcattgttattactcagttcgacaagcgcaagacactcaacaagagtgtagctgaaattatcaatgactctttctgtgacaaagtgttcaaaacgattgtgcgggacaatgtggcactggccgaagctcctataaagggaaagaatgtctttgaatacaataagaactgcaacggagccaaagattatatggctttggcacaagaggttttgaaattaaaataaggcaatatgggcaagagtgatttattgaaagacagcatgaaaagcggactggacggattgctgtcatccacgaagaaatctccgcaaaagaaggaaactacatcggttaagacagaaaaagagcctgctgtacattgcaattttgttattgacaagagtgttcatacgcgtatgaaattccttgctattgagaagaatatgtcattgagagatattgtaaatgaggcgatgaaggagtatttggaaaaaaacgagaagtgaggtatgttcctcgcttcccgttcttttaagtctgtggcctttgttagtatgttatactgatatgtgttgctacatatcattcattgacagccctttgtatgacagggtataacctttgaactctcccgttgcacgcatgaaagcggctgctttcgtttccagtttttccatgtcgatattttcggccttgcgtttgacttcgaaaaatgtcgctgtatcgtccagttcgttttcggctactatgtctatttcgttctcaccctttcggtcccaccagccaccaatacgcgtatagacttgccgttctatcagcacacgcttaaagtaacgttcaagcatcagaccgctgaaagtttcataatcccggcctataatcatcttcacactcccatagttctctatctccagcatatagctgtacttgtagatgaagcggaaccagaacgtgaagaaattgtcctcgatgatataccggacattcttggcggaatttttctcgaacaacggttgcttcttcgatatgatttcgtattctttctccagcttggtaagatagccgccgatttccttgcctaccacgttctcgatttccgaacgggatgtttttcctcgtgcaatggccgacagtatggaaaaatagattccgtaatccttgccgaactcttcgataagaatcgctttaccctctcccaaaaatatggagtcggcctttataatctggtcgagcatagccgttttagttgttgctcctgcatccacgagtagttgcacgtacttcgccacgccgcccgtgaaagcgtacaaggccagcagatcttccgccgtgtagccgggattgtattccgaaagaatatctttcagaacagtcggagtaaacggatgcacagtcataaagcgcgactgccggttatacaacggctctttcttatccttgaatatctttgtcatcatggaataaatcgaaccacagacaatcagattgatgtgtgacttcgggctgtataggtcccagatgcgctgcatatcgctgaacaccgatttgttcacacggaaaaactcctggaactcgtcgataaagagcgtgatgggacgttctgccgaaagtttcatcaggaactcgaacacatcggtgaagtgctcggcccgtcccatggtggggacacctaacttgtgctctatctcaagccggtagtcctcacacaaatcgccttcagctttccgggcaacaaagaaatagagaatcggttcgtcctcgtatgccttccacacgagtgatgtcttaccgatacggcgacgtcccgttaccactgtaaactgagcattgtcttgggccatttcgcgaatcttgcgaagagtggctatttcttctgttctgtcaaaaaatctcatattcttatcctttcttattgccgtttccgaaatggctgtttccgaaacggctgtttcgctactgcaaaagtaatgcaaatttccggtaaaacaggcaattgatacagatttatttagtaaaatggctcaaaggatttttgtctggtaagctccattcctgttttacaccgtctggtcttacgcccttccgcttgtcccgttgtatcatttatcatccctttgtagtcccatcggttttactatccgcctttcggcgtattcttccttttctatattcttttaatgccactcatccggtccattcctgccatcgccggttggttttccagacgcaaaggtggactgccgcgcttgattccgtcgctttgaagtgcatttcctataaaattcttcctttctgcgaaagagtaattttccggaaaaagcgtcggaaatcgcttattcgtcagtccttgtaaagcatctgtaaatcccaagcggttcaggcagaaaaaagaaccgaacaaagggaaaataaaaaatcaaatattaaaccaattaaatttttatgattatggaagcgacagcaattcaatcagcagagaaaaacatcacaatggtagcattggcaaatgtgcaaccgagtaattacaatccacgcaagaattttgacgaagcgagccttgtggaactttccgaaagcattcgtcagcagggtgtgttacagccaattggagtacgcccgatagaagacaaccgttttgagattgtttttggagaacgtcgataccgagcctccctaatggcaaaattggaagaaattccagctatcgttatggaaatttcagacgaggtagccgaagaaatggctgtcactgaaaacctccaacgtaaggatgtcaccccgattgaggaagccaatgcctaccaaaagctcatagatagtggtcgccatgatgtgcagtctttggcagtgcagttcggcaagaacgagaactatatccgtacacgccttaaatttgtttccctaattcccgaaatcgcacagcttttggagcaggacgaaatcacaatcagcgtagcgagcgaaatctgtcgttacggtgaagatgttcagaaagatgtgtacgacaaacacctcaaagaagatgcactgcatcatagttggcgagggatgaaagctaccgaagtcgcacggaacatcgaacggcaatataccaccgatttggagcggtacgcatttgacaagaccctctgtctgtcctgtccccacaatacaaataatatggtgctgttctgcgaaggtggttgtggaaattgcgccaatcgtacttgccttgcagaaatgaatgcggcatacctcacagagaaagccgtgcgccttatggaagaacgtcccgatgttcctctctgtcgtgaaaatactaactacaacgaaatcgtagtagaacgccttactgctatggggtacgaagtggaacgtcttaattgttatgcgaaagcatatcccaaacagcccgaagcacccttaaaagaggattacgatactgccgaagaatacggacaggcacagagcgagtacgagcaggagttgaacgattacacggagaaatgcgaggaaatccgtacccgatgtgaagcaggtgaaattaccctctatttccgtgttgagagcaaggatattgtactttgttatatgaccaaagttacctatgcctctaatagtacaaatcaagagcagacactttctccaatggagaaattggagaaacaagacaagcgtaacaaggaaattgttcttgaaaagactgtagaggacaccaaaaaacagattttggaagttgatatgtccgagtgcaagtttgggcaagacgaggataagatgatttatttcttcttgttatcatccctccgcaaggagcattttgaagcggtaggtatcggagaaaaaaagccttattgccaccttacggatgaagaaaagataaacatcatcgccaacctcacgagcaagcagaaagcgattatccgcagggattttctaattgctaatttcaagaacgcatacggcagcaatgccattgcatccctcttgcttgacttcgcacaaaaacatatgcccgacctgttggcagacatcaagaacggacataatgaagtgtatgagaagcgtcaccaacgtatcgaagagaaaaaagccgttcttttggtgcaggaacaagcaaagcaggaagcggagcaatctgacaaacagcaatccgaagtagggatgcagaccgaagaacagccacaagaggaagatattgcagcttaaccataatcactaactaacgaatagggggtagagtaatctgtcctctattcgttcctaattcaatgaaagtgaagatgttcacggacaactgctccaagctgttgtcgggcggcgcgtctgtcgggcaaacccgccatccgcgcgattatgccttttctattccatttatagctacctcccgatgccccgccgccacccgtctccatttatacctatcagtttcctcctttttatcttattccttatccggtccattcctgtcctcgccggttggttttccagacgcgaaggtggactgccgcgcttgattccatcgctttgaagtgcatttttataaaattcttcctttctgcgaaagagtaattttccaaaaaaagcgttggaagtagcttgttcgtcagtcctgtaaagcatctgtaaatcccaagcggttcagacagaatatagaaccgaacagagggaagaaaaataaatcattaaaatttcacgacaatggacaacatcaaagaaagcaaagagtacaaacttgccaaagaatgggaaatggcagtgaatagttttagtttcaatcccaagcgttttgcagccgctatacctgatatgcaccccacactgcaacagagcctctataggttgtttaaggagtgcatcattgtgatggcggacgagacacgtctctatgatgaccgcaatcgtgcatcacatgaagaagcaaagtgtcttatggaatacctcaagacaaacggaaagcatatcccattaaaataataaaataacaagcgtatgaaaacacaagaagtacaatttggcggcaataactatccttgccgtgtggtggaatccaacgagggtgaagaactccttatcggctcgactaccttgctcgatgcccttcagcccggtagtttcaacgatgaaaatgaaggcttcgcaagcaaggaagccgaaagaatctataacgaggttttcttctttaccgatatggcaaacttacgacttacagacgtagaactggttgccgaactgaaaaaggacaacccggaatggttcgaataaaaaaaacaataatcatcttaaaaatagcacagttatggaaaaagagtatgtaatgcaaatagcacagaccattaaagagcagttaataggacttacccctatgcccgtcctcatgtcatggggtatctcagagtttgcagccaccatcttcaaagagctgcctgcacttcgtatcaaagtaaacggactgttacacgccggatacgttattattgcacttaatgggtcagattattatgagatatatctgttgaaagacaaagatgtagagtgtgtcaatgaagaagtttgtttcaacgagttaggggatgtcattgacagggcaattgaatgcggtactgacaaagaggaatacgaaaaaatttgccatcagcaactcaccaaattattaagcgggcagttctcctgataaaccggaagaagattagtagtaaaccgtcagtacgattgtactggcggtttttgttcttcttatatcagacagccggatttttatttcgcgttacgcttgttctgaacgtcctttatcatctctttcacatcttgtcctacttgtacaaagtttttgtataggatgcgttcccgttcctctctcgacttgaaggtgtagaacttcggcagcggcacatacgccgcttcctctttcttgattgctgccatatcaaaatctgttttacagaagaactttgtagtcttgaactcttccgattcttgaatattcattgaaccgcccatacctgttttcgtcttcacaaaatcccgtgccgtctgaccgcatatccatccggttgccatatccgagattttcgaggcaggcacaaggttatccatattttcattgagattgatacttgttttgtcccggtcaatggtcacgccttttttgacctgtaccaccttgccgaagatgtcattggacaaccattccagcgtttctttggcacgtgccgagccgcttaccacattgcctaccgtcgtaatgattttttgcatacctaccttaccataatcggcttccagttgcggtagttcctgaaagccgagcgttacactcaccttattgcttcgcgccgtacctatcagacggtctattttgtgaaagtagagtgtcggtaactcgtccactataatactcacgggaatatttttcccctgcccggtattcacacgggtaacgaggcggtttaggataagagcgttcaatgcgccgatgatggactccatttccgggtcatttgcaatcagcaggtaactcggattcttcgggtcactcaccttcaggtcgaagtcatcgccatcccggtggaatatccagtagctctctttggttgccagacgcgaggtataaacacgtaacgtgccaatcataccctccagttgctccattgccttatttttgaaagctgtctggaacgggccaagtagcggagcaacctcattgtcagtttccagtacctcgaaaatcgtctgataactttcattcaagaatgacagaatatgtggcatgtccgaatactttcccagccagtaggcaggttccacgatattgccgccttcacggtcacgcacgatacctgtcggtttccagaatttggtctgcggatcttgctgtctttccgcatatagaggcttgccgttggcatcgtagggttcacgctcataattcacgaaaaagtatatacaggcggcaaggaagtttaccgccgaggtttggaagaactggtcgcttccgccgccgccctctttcttacccttttgtaggctttccaataatgtttccgccgtttcgctggccgccgcgaggttgttgatgtactttgcctgaattggattcacccgacggctgtactccacatccacaaaattaatcatgttgaacttacaccctttgggtactctgcccagtttctcgttcctcttgtaatggtagtagagcttggtcgccaatgtcggaaacttgtagtcatacaccaccatggcgaaacctttggccgaatgctgtcggataaacggctctatgatactgaaagtcttgcccgaccccggtgttccaactacccatgttcctctgaagcagttacttacagaaatccatcccttgcggaatttacccttatagtagtaccgcatggggatatttacgctgtattcattctcgactttttcctcacattgttcaaaactttcattctcgaagttgaaacggtctttcatcagtccctccttgatgaacttcgaaatgttgtctaatgcaatatgtaccagtactacgccagcaatggaggcaatcatatagagaatgatattcaaaggtaaggtataaagccttgttcccatcgtatggccgaacatccatacggagattacgagcagcaacaacccgctcgtcaatggatacaccacctgccggcgtgcgttgaactccagatgcttcttgttccgcgttccgacacaagtgatgcagataagcagtaccgtcgcaattttgctgtacacaagattgccgtcgtggtaaatcatccattgtttgatgcgtccgtgaatgtcggtcagtatgccgccccagtggtcgagcattgcagggtcaatggcatattcaaagaactccagtagtacggacacatataccactgtgcggaatatcttatagaacccttgcaattccttactttcttccataagtcagtctgttattaatccctgttttatacgataccaatgattgcctactctgattacatccataccgaaccatgcaccattctcattcagttttgtttttatcttttcgagtgttaccggaccgacaccccatatttccatgagatattgctcgttaagatgaatcaggtctccgatatataatattccatgagattcaagatggcttttgatggatggggtaatacccaaactgaataccggttccgagagatagtgtacttcttctgcttgaatgttattcaaggctatttcaagtcccactttgattcttttgagagaatcaaggcgttcttgtatcttttggatggcaagctcgtcttgctgtatctcattgcgtaactgggttgctctctttacaagttcggcattacttcttttcaattcttcattaatatccgccattgacagattgcttatttcaagttcgtttcgtgtgtggtccaattgcgtgacaagttcctccagtctgtcggcatgacacttcagtattgaatttttttcattatcggcagccatttcgtccaaaaggtagccgaaccttttaatttgaaaattaatattttctttatccgatgctatggaatctgcgagttttgccagtctttgccggcatgaattacctttcatggacttatacatgaggacaattcccaatatcatcaacgctatgctgaaaagtatatccgtatctttcatatctttctatcctttattcgtttatggtaattatagggcgtactctgtgcgcctgtactttaggtgtttcttgcattgcgccgctccccatggaatagagccatgccttggctgtctgttgcttttcgacctctgtggatgtccagtaccaacagtcgttttcatccagcggtaacggctcgccgccacattgttcgatgacagggttgactatctctctcatggtgtagagcagccgcatctctgccacggacggtacataggcactttgtccgtaccgccataggtcgaaaaccgcttctgccattggcgaagccgtttctcgtgtatcgtacagtgcgaatgtattctcgttgccatcataagccatgatgtcggacgatgtgccttgtgcgatgccgaggctgtcggcgaatgcctgtggagcaatgtcccacaggtaaactgcataaccgcccccctccgtatctccgcgttttccggtatcgaagacaaccgctatcgcttttttccccgattgttcatattgtgcataaggcaaggccgttccgtcctcgcagaggatatgtcctggacggaccgctgtatcgggtacgtctatgtgcgtgtcacaggcagcgcacagcacggcagccgttgccgctgccaccaaatgtatctttcgtatcatattgctttctttttttgtttccctatttcataggtagtttcacacccagcacgacacctgcacgcagcacgtccgcaccttttatcatcacatcgcttttcacttgccaatacagtgtccatccggcccgtagcacatagttgtgttcataaccgaggtgcaggccgccgaggaatttattcgtgtcgcttccggctgaagctccgatacgcagactgccatagtggttgcgtccccgcgtcatgcacggcttgtaggccacgccaaaaccgtagctgcggtagtttcgccaaaatgattccggacagatatgaccgcacgagccgcactctgcccattgtaggtagccgttgacgaaaaactcccacgcatggcggtagttcatttcatgttcgtaggcgagcgttatatccatgccgttcttgtagagtagccctgtgtcaagtgagaggcgtccgctaccttgttgtgcattcgcacttgcagcgacacacacgcaggtaattatcaggatgattgtctttttcatagtcattcctcctccaataaatctgcatggaacgaatctgccgccagtatatcctcatagtcgatgttcaggctgatgttacggccactaatctgtttctccgtcatttcgatggtcagcagcttgtcattgggaaaggtcatctttttcacgacaatcacattccgatagccgtgtctgaacgtcttgcccggttccagaaccaaggcaggtgtcagttcaatagtctgtgcgttggttgccttggcgagtttcttgtctgtcagttttatccgtatctcatcaatgtcaaaacggatgttcgtcttgttctcgatggaaaagtctatgaagaagtagttacccaccgagtagatattgttcagacgcatcaccatacggtgtgctttggtagctacgttgcggattttcgcaggtgagttccagatgcgccgtgcatgatgtgtcatgtcggcagtggacattgagactgccggattgttatacgcattacgctcttgcagcagtatctccttatccgttactgcctctttcatccttgtggtataaatcagtgcgtattgtgtgcggtaccgttccgttacaatggtgacgatggcgagtatttcaccatcctcgtgtccgctttccttgggctttaggcggatgatgttgtcaatgggctgatcacccgccaccttgtcagtggaaatatccacgaaacgcaccggttccgatgccgttatgacggttgttatctgttcgttcaccgtcagttgttccatttcctcataggtcgtttgcgcctgtgcgttccgcgccagcggcagccctgccgccagaagaaatgacattgcgattttcttccaattcatatccatgttgttaattatatttattccgtttatttcctcttttcccttatttctcctctttctttacctgtttggcacgtacccatgtacaacgccccgtccgggtcatttggagttcacactgccaaagagtgcctttctccactgttttgaaattcacatttccgtatcttggtccgtaaaaaccggtatgtttttgaaaagcgaataaggcaatcctccgtctgtcttctgtccggaagttgcatattagggcaaactgccctctgtgatgccaccactcggcactcacaagttttccgataaatgtctcggctttattgggggctatatagtccgcataataaagcccatccgtacctttgtgatattctgataaatctgtttccatgtcatcatcgttttatttccttttttcctgtccgttcaccaaatacacgaaagttccgtatttcagcttgactttgtttttcttgatagctttgctaatggcattgcttgttttctggtaggcattgttcaccgcctgcattccccattgtgcaaggctgtttcctgtacttcccatactcatgttcatattgcccgacattgccccgcttgctacatccttgctcgtttcccggaattggctgttgggtacatacagcccttccatgccatcagtatcatagagtgacagactcactttcaccagttcgtcattcacgaggatgctgctgatattacctttcacgcgtccggatgagaatccgctcactgtagcgtacaggtacgttccccttgctaccacacactcgccaatctccacatcgtcaagcaggcgcaacctcacgcgcgagccgtccaccgctttgatgttctcgtcaatgatggcttggataagtttcggttcacggacattcttcgacagtgtgttaaagtagtccgaggttgtcttcaccttgcgtaccacttcgctgggcggttcgtccgcagatggcgttttcacagcccggctctcttcgttgatggttccggaggctgttgctccttgtggtggagcaatgttggccgtgtccgtttctgccgggggtacagtcgcgttttgccctctcagtctcgcctctgcgagtgctttttccagttcggcaagtgcttcttgttctcgtgtcttggcagaggcaatttccgctgccgcagctttttcctgttgttcttccgtgagcaggtcgatgtcgtcctgcgtgtatttcgattcatactcttccttgtttttatcgggttcttcccggtctatgttatctactgcggagtagtcctgtatcttaccccatgatttcgccatattctcgtatttgctgcctatgccatcgtccttgatctgtgcccccggcaattcggggttcaggaactccgtcgtctgcaatgccttgtcttgtatttctatcgtttctgtctgaaacaggtcgaagatgaaataagacgcgccgagcagggggaaataaaggatggcgggaagcatatatttcggctggcgaaaattgattttctccaatatcttcattatacatcttttaattgagttgtacatacttgccttcaatggcacaatttctcagtatctctgcgttgtcttctccgaaagctaacaggaggctaccgcaaccgggagagtcacctcgcgttccgtctggtcggtagaatcggatgcggtggcgtaggaatttcattcccgttgcttttgggaagatgacgtcctgaaacattttggaatcacaacggttgaataataatgcaatgccgttgccatgttctgccagtttccggacgaatagctcgataagaggacgcgaatagggaggattgagccacacacgtccttcccatatctgggacaacccgtctatgttctgatcatacatgacctcggcagtcggccacaacggacggataggagcgcaagggtcaaggtcgaatttgcccaatgcgtccagtatctcctttggcgtgtaccattcgtctgacgaacggactgatttttcaaaccgtgtattcataagcattcttttactgtggtttgtcccctctgtttttatgttcccttatttcgacttcctgtaacagcttgtgccgttcccgaagtacagaatcctgcatttccgttgccgtgcgacttgtcgggctgtgcctgtacacagttaccaagcggtaggcgttccatgcgaaagctccgatgacgaatgtaaagacgatgaccagaaacagcgtccggtgcgcgttggcaaagccctgcgccttggccgccgcttggtcgatacgtgtcgccttggcgaatttgtgcccggcctgcacctctcgctcgtagcgttccttgtactgcgggtcatctttgtccggcatcttctcgccgaacaacatccgtttgaatcctttgatattcatatctttggtgatttaatagttactctttgttttttgctcgatatctttgttcagcaatgtgcgccagtttactatgagcagtccatgcggattgttgtccgttctcggcacacgtttaagttgccctgccgtaaccagttcgcgcatcaggatattactccgacgttcgattcgctgccgaccatagtaggtgaactccatattctttttgtcaaaggagatactgtcacagaaaatcgagaacaccgcgctcgtacccaatatgttggagtaaaatcccttttccttgagggtattgtattgtgccagtcccgtctcatcgaccaggtacatcgctttttccatcgtatagcggatgtatttgtcgtccggtgcgagagtaaaaaagtaatggtggaacatttctacatggctcttggcttccacgtccagcgtttcgtccatcgtcgtgcgggttacgagtataggtacatttccgtccagcacatacacctttttctgtgcgtccgtcaccattgtccgggcagtccagatacttgacacactgatgatgatacaccctacaagaaaagcagtgcagatgatgcccaccagtcggattttattctccaaatgcttgatgaccatatacctttattttttcttgttagacaatcgtgtgtattcgtcatgtaacattgtcatgactgtatcctgtaactccgtcagaaatttttcgaacttcccgtcaaagagctgtgtgtaatcttcccgcatgattacatgcacgaatatccaccagatacggcggtttcgattcttggcatttttctgcaatttgaccagttgcagacgataggtaaggtaagtcatcatagggacgatatatcggttgtcccatgtaacggcttcgtccagttcttcatattccggatcaattcggtggttaggtgcataaacgagttcttcgcttatgcgttcatttgcatagcgcacgaaacgctcgttcctgcaccatttttcaattttctgttgtacattcatcttttggatatttaatattaggtttatcattatctcatcatcgagccgataccgcccgtagccgtcattttggcctgctgcgccacaccttctccaaagttccgtgtagagaaggccgtgtcaccttcaggtatcatccatgctgccaagtccggtacgaggtttaggcatttcagtgccacgatacttgccgccatcaagtagccggcggagaagaagctgttttgcaagtaggccgccatcgtctgttcgcttgctgtgattgccgtcaggttttctatctgtatgcacaatacaatgtcgaatagcagtagcacatagaagccgacgaagtagagcatcgcaccatagaaatgtactgtcagataccttataagccacttcgcccatgcaccttcccatttgggcaacagcgagaacgcccattgtataggtccgaatattgttaacatgcccagtaggatttgctggcagtagatggtcgcccaccatccgatacgatacacaatcagagcgataagcatgatgattttatcgatacctacgatgactcctgccgtcagtgaggtaaaccacagttcggctgcgtctttctccattttcgtcacttcgtccactccggtttgttccatggtcgcttctaccagattcgggtctgaggtacccgtgtgagcgacatctgcctgtgcttgcaaactttggtacatcgtgtcacgtacatggataagttgctgcacttcctcgaatttgtccgctatttgggtggcttctgcctcgtacaggtcatgcgtgtacgagccgatgcagttcgggatgtaagacaggaagtcaagaaaacaccaactgctcccactgccagccatacccgtgtctgctggcggataccaccaacagaggatgattgaaacagccaaaggacggaacagcttcagtacatccagtggctcatgtttcaccatcatcttgtacgccattcccgctgccatcacaatagcgaacagggcagccagtgccatgcacatttgtagtatccaccagaacggtccctgcgagccggtaaaagtcgcatcagtcaggaactcgttcgtttgaaaaatcacatcgtctatctcttcttcaaggatattgataccgaaatccgagagtatatttccgtctgccatacgtttttgttttttcagttccctttgcttactgtttcatctccgtcaccgctgtcgcccgtgttattgcccgattgcgggccgcgcacggcaaagcgcgattcgtgccaccggctcaccgcatcgcggacaatactcttcttatccagagtacggtcagcggtagcgttcagtagcgtacttgttaccgtagtattctgccgtttggcaaggtagccgacaaggatttcgttctgtcgggttatatcctcgtagatgcgcagatactcttttttccgctgtgcgttgggcatataggcatctttcgttgcatcaatggcgcactggtagatatggtaatattccgtccatctgtctttatcctccggtgtccccccgacaggcaagatgcggtctatatttcgtttgaaccgtaccatctgtccgttgaccttatcgccttcggcgagccatgcgatgtccgcttgacggtcagccacgttcaaggcctctatctttgcccggctcaccaatgccgagtcgatggcttcagcttcatccgtttggttgtacaggttgacgcccgccagtgtgcggaacgacagtttgttcttggctgctgccgactttttgtacttgttgtgcagtatggaatagtagaggtcgggcgagagtgctcccgtaccggtttccattactgttacttgattttgtttcggcgaatcgtggttataggtcacggattgtgcctttgccgccgtggttgcaattattgtaaccgtcacgagtaagagtattctgtccatatttactttcggttattttgttactaatctttcaatactcaatgtgcttcaatcagttaatcaccgagattattccacatttctttttatattatattcatttctaatcctttcctctccccgcgagaagtgcatgtcatccttttcaatacaaatacattttctattcgtatgaatacaggcgattgcagtgctcatgcttccagaggcaaaatcaaggactgtgtcaccctctttcgtgtatgttcttatcagatatttcaataatgcgactggcttttgattaacatgaatcgttttgccctctgattccgcagttttgaaatatttcacacttcgtgggtatctcgttcctttgttttcatttctgaatgtaggatttggtaccttgtttactcctgtccagttactccctctctttgtacgattttcataaggctcaccttcttccatgattggataataaggagttctgccgttacaaaagatactgattagctcatgcgcttttagaggttgctttttagcaagaaggaaattgcttgcttttgacttttcccatacccagtcatatttaaattcggctaaattgccacagcgtaaaaggctgctgaacggttcgctgccaaataaagccgtaggtgcattatcctttctcacccttctaatctcctcccacattttcgagaatggtattatcttatcccattgcgaagctgtaattccaaaaggtgggtcgcatagaactaaatcaatacttgattctgggagaagaggcattacttcaaggcaatcggctttatatagcgtaatgtcttttgcaaaaacgatctttttcattacatcttttattaatccaaatgtccatttgcctcttggttataggccggatagacttgtttgtacttaaagtttctttctctgtttgtacttctccgaacatccaggacgaaacgcttttcctgcgttttaagatattccttagcaatttcggtgcatagaagtcataatctaacttgtggcattatttacctccttcctcttttaccgtcaataatccagtcgtcccgcattgcgccaccgtccgaaagcaccgtcaataatttcccgtttggtacgttcccggtaaatcttcgatttccagtagccgatacgtacctgtatgtatctccatgtctcgatgtatgcccggttcaagtgttgctcaatactgtccagcgacttgttcacggactccagtaccatcagcaggtcgctggtcgagcaggccgctgcgcccgtggcatacagcacgaggtcgctcaccgacttatagaggtgttctccctcgttggcgatgtcccgtattgccttttcattgatagtcagtatcagtgcgtctgacggctcgatgttcccatgtttcaggattttctcatggaaagcctccagcatggtcttatagtcaccgatacggtcacttaccgaactgtaggtatccttcacgttcagcaccgtccgtagggactggtacatcacgtcgatgacatcaaaggcacgggtatagcggtcaaggtcgatattcacttccttgtatttgcccgtctcctcacggctgtactcgtgcagcagttggttgctgtattccagtgtgcttcgggccaataacaggctgcgttgtttcttgtggtcgttgatgtacgcttccaccgacatgatatcgaatgtccattgacccttggctacattgggtagtagcgcaagcaacgtgatggctatcagcatagtgcgtttcatggtcgtacctcctttctgccacttcgggatgtccgtgcgttttctacccagcggtcatggcactcttccacgagcgtcagcctacgaccctcgtccgtatcgagttccggtagcacatccttcagtacgtcgatgatgttccgcttgtagtgcatcatcttctccaaggatacgaggtcggcgtatattttcgtgatacgtgaatccacttctcgtgcgatttcgaggcggtcacttgaccaaagcaggtggtacacgtcgctgttcggtacttcttccataggttctgtacgggcatactcggtagtgattttacagttgggatattcccgtgcaatttccgatatgcgattattcacgattttagtcttttcctcgttcggcaggttcggatcgagtgtcagtacatcggcaacgtgcgtgtctgtgtatgccgaagtcaattcccaactgatttggatgatggcacggtggattttgatacccagaaagtatttcggcttccgtgcgatagaaatagtcgcacggaacgtaatgataccattgatgttcggcatcgtcgccttacggacgaacgtatagccgctccatgtacctccgtcctgccaagtgaggctgtaggctgtcttacaatcctgcatgatggccggtaggcggtagtaatcatctgtcggcacatcgttctcagcttccgcttcctgcttcgcatctgcgtactccttctgcttttgttgccactcggcaagttcgcttttcagttcctcgatacgtgtccggttggagttatattgttgccggtaagctgctgcgtcttccacgctcgcctcggcaatttttttcagaaggtcggcgttttccttttccaaggcactaatctgagattgaagaacggcaacctgattgtccgcttcccgtatcagtgcgtccagttctgaaaggtccagttcgttctccgttaccgaggtctgcatgacgcactctttggagtgggcatccagtgagccgccacacttacggcacttgtattgtgtcgagccttgtcccagcgtcgccccgtctgaacaggttacactgatggtcacgctttcacatccctgcaattttgcggcgtccgtcgcctgataatagttccgtgcatcggatgctatgtaatagacatagccttcctcgttgtcattgaactccgagaggcgggcattgagctgcgctttgaacgtgttcagatccatcgaataggaatcgaagacatcctcatagactacctccgtccggttccagctctgtgtcacatgtatctcataggcgtatgccttcttggtctgcttgttgcctttgctgatgatgtaggcctgttgtcgggtattgatagtataggtgtaaccgtcgttgctgttgttgagctgttgtactcggcttcttgaccatccggcatactgttctgagttggcaagggcctgctcccgttgcgaagcgttcgggtaaaatcccggatcgctcgtattaaagcgtgtccatgcgcccccgttcaatatgctgttgtcgtctgtcggtgggtagtagtcgcatagagaaatgcttccttgctcacgccgtgcgatataccaccgttgcgtgtaatagttcccgactgcattgtccatgtagtcggtcatccacgatgtgaggtcgtagttgctgaaattgaacaatgcggccacgctgtcctggccgcccaccatgtcgattagcagactaccgatgtcatgttccgcctgctcgaagagagtaccgtagtgttcatacaggttgccgatttcattggctttgccgcccaacaggtcatggaacgcactgctttgcagtagagcgtcaccgaggttctccataccagatgttgccagccctacgcccatgttataaaggttgtcgatatcgcctttcaagttctcgatggtgaaattgcccggcactttggccaagttgtccaacatccgttgccaatcggtaccgcccagttctgcgaggttcagcaaactggcgatgtcgcggtcaatttccagaaaagcgatgtccgagaacgtcagtgtgctgttggtcacaacgctttcgaactgcatacacaggctcttcgtatcatcgcagactttcatcaggtaactgccccagtggatggctgtttgtggtgagcgtagcatcagtttcgctaccacccatattttcggcatgattttctccgccaccatatggtaaattcgacgatagtagtaattttccgtgctgctgcaccagatgccaaggtcggacagagccttgtgttccaaaaatttggaagaaaatatccctgctgctgccacctctgccgccgtatagtgtttcagaatatcatccacctgctcgcggtagtagctttcagccactacctccgtgccgaatgcggcggccatggccgccacggtacgtgcgtcatagttcacgctgtaatattgtgcgtgaacgtgctgtgtcagggcaggcaataggataacccaaaagataaacagccgtttcatcgtttcagacctcttttatgtattccggttccttgtgattgaaataccaccgctcagattcgatacaattctccgtgacaagtcggcagaacatatcatgtatgatggtagtatccttgatggcccttttgatccgggcttcttgggagccgaaccatctcaagaagaaaggctggtttagataagtttcgcgcacggtctgatagcgtagccatcctaagtcactcagtcttttttcactcatcggactgctgttcagttcccggaatagttcttcacgaaatccgttttcatcgaaggcaggtttgctgctacacagcctgtcgcacatatcgtaaaactccttttctttggggttttcttcataatatcggttcaagtacgtttccagttctacatcggacatacccaaccgaagggaatactccgccaatagccgttcgatggcagctaccttgtccggtgtcatgtcatccatacggagcaggttctccttggatagcatacaaaactcccggagggacaaaacagtgagttccggattattgacagaaatttgttcgcgcgtcaagctgctttcaaaccccatcatatttattccgtagtccagtgacagggtgattaaaatccttttcgttttcattatgatgttattttagtggttaagttcagtacacgtcccgcttcattaactttctgtgcaaacggcaatgccttgccgataccgctggcatcccagtcacggcaatatgcctcgatagccttttggtggctgcattgtagctcgcgcttgtaaagtttcagagcctctttctctgcccgttcagtcgtgtaggtcatgtagcactcgtgcggttcctccacgccataaacaccgctggtcgtgccccggcggataaatacctcgcggaagaagctgcgtccttccttgttttcgaggcggttgatggtgaaaattttcttacagtccacgtccgttaggccaagaatcgccttgatggtatcgaaacgttccttgaatttgctttggtcaagcagcatcaccacatccgagttgttgatgatggcctctttcacgatttcgctgccgatgatgtcctgtatctcctgtgtcaccacacctacactggcccagaatttacgtgccgttttgtacataaatttgatgtattccgccatcagcgggctggcgatggctttccacgcttcctcgatgacaaggactttgcggttctttttgatgcgcattttctgtaagaaaacatccatgataatcagcgtgaccaaaggaaaaagcagcgggtcatcttttatactgtcgatttcgaagaccacgaacgtctcgtcgaacagcgagctgtccatgttttcgttcagcgttttttcgtggttgccgcccaaataaaagtccttcatcatatagcggtatgtcgagaggtcgatgcccgtgatacggttctcctcacagatatccgggatgcgctgcacggaatattcatagaaagagttgaatgacagttcctccactttcagttccttgcgccgaccctctatctcgtcaatgataccctcgatgcgggccgcacgttcccgttcgctttcgtgccgcttctcactgctgttgcggtcatcaataacgaggctcttacgcaagtcctcacgctgttggggtgtgaagctctcgaaaccgttgaagtaggcgtcgtaatattccgtgatgacgtgctctatcagacggtcttccgtctttgtgaccgttccctgcgtacctttccagataagcaagacgaggtttttcaggaatcccgttttttctacgttcatctcttcccgattgatgcggaacggattcatcgtgatgggccgttcctcggtatagctaatatacttgccgccgaaatactcgcatagcccctcgtatgagttacccgtatcgaccattaccacgtccgtcccctgttcatgcaactggcgcacgacggaattcatgtggaaactctttccgctgcccgaaggccccaggcagaaaaaattcgagttgtcggtcagcttgttctttccctcttttcccgtgatgtcgatagctaccggaacaccttgacggtcagtgtaataaacttttagcggtgtttcctcactatgctgcacccgttccttgtacatcaggcataccgcagcgtcggagagggtcagaaaacggtcatattcctcgttcaggctgtaacagttgcccggaaacgaactgacgaacagttccagttggttgtatgcacgcttactgatgtgtatgcccatgcgcccaaaagcgttttccaagtgattcgtgcatttttgcaggtcggtgtccgcaggcacgcccaccaccatgttgaagtgcgtgtacacgagcagtttgctttcacgggctattacgtcctgtacctgtttgatgtcctctacggccatttggttactcggattggggatgcttgcgtgccggttcttctttttgtcgagtaatgccagttcccgcttctggctgggcaggaaaataatttggttgtacaccaccgtttctgcgttcggaatattatccaccaccgagacaagatccactggcatctcggtattattcacctcgatattggtatagggacgtatcagcgaggggagcgcggcgcagtccacgtccacgaggctgtacaccttacagcgtttgtcacccatagataccgtttcgtcgtcagccttgacattcgtcatcgagaccatacggtctttgaagttcatcgcaaagtaacggtccacatattcgcttgcctcggctttgttcaggaatttcacttgtacaccgctgtcgcgtagtaggtctcgaaccttataaattttcacgaggaaatcgcgccatttcttgctatcgtaagagaaaagacggctcttcttggcttcctgtgtgatagtcagatagcaaaggctgtccgtgtacggacgcccattaaaataacggaagtacgatgccgagagaaattcttgattatgctccggctcgttcgcgaactgtttccttacgaagatgtcttgtttgtgcaaggcatacccttcgcccagcgtctgcgcaagggcagagaatagatgcgtgaagtcgtaatagctgtcaatgtccgctgaatacttctgtaccggattttcgattttcaagacggcggaatattcgcccgtcttggtgtacagcacacccacaccgtctgtatcttccacagagaaatagatattctgaaagatatgcttgcgcttgccgcccgtaccgaacgtatagactgacaaggccatacccgtacatagggcgatgaaaaataaaatgatatatagggtcattccgatattcgttcattaaataggggcaggtctgcctcggctggagacggacccgcccgcgttcaacaatcaatcagccacacacattgccgtgatggtttttcttatagtcatactttatgcgaataggcatacacatacactccacgttttacatttttactgtgcagcccctttcgctgtttgaggatgataagcacgattcccgcagataagacagttgccaatacgaccagtccggccacaaagcccataagacagtaggcggcgatgaagcccacaatggccccaccagccacgcctgccgcccaatagatgtagcgaccttgtaatcccatcagttccaaaggccgttgcagtcctttgaacagcgggtaatccggataacgtccgttattagtcattcctccaggctgtttatgcgttaattccgaagaatagaggtaatgcttgggctgccgcaatcaggaaaaggcacgccccaaccaccatcataatcttcttcttgacatcctgttcctcgttgttcatggcgatatacaccgaaatggctccgatgatggccacaacaccagcaatggcatagcagagtttgaccatcacaggaacgtatttcacgatttcctcggctacggttgatagagctgtcgtaccggctgagtaatcgcctgccgtactttgagccatagcaggtatgcctcctaacagggcaatgattaacatttttactttggtggaaacttgcatgatggttttctttgcctttcggcacattcttttgaatttctgaaacatatttattacattttttgtggtacttctatttttgaattggttttacactcctgtcagccacctatatgcggtagccgaagaaagcggggaacacgattgaagctccaatgatgaagaggcacgcaccgacaagtgatacgatagacttcaccacaccgtcctcgcctgtgttcattttgatatagatttggagcgcggcaacgactacgaaaaccgaggcgacagcgtagcagatgtacagcacgtacagcatcatcgtcaccacgaagtcgtgcatcgttgcaagtgcgtctgcaccccaactgtagtttacgctgccgcttttggcgaataccgcataagggacaaagcacagtgcacataatattttttttgctttcgacattttacaatcggtctttgagaggtttccataccagttccggacggttgtccgtctttcctttggcaagcatcgctttgtacagttcgtctgccgtgtatgcgtccgacaggtaggtctcggtttcttccatctgttcctccgcttgggctttcagccgtttcagcttctccgccacggctatctcgccattattctctgcggtttccgtctcctgtggtgtaggtgaagcggtaggggcaacatctgtttcatacttctcattacccacattgaatcccgtatcgctctccgtcacggacacactctgttcatcttccggcgcaccgaggtcaaatacctcttcttccggcttaccatttcctttttttccataaaggtcctgcacgatgataaccgcataatagacgagataggcaactgtcaggacaatggtgaaaataaaatatgatttcatatctttttatgtaatatgatttattatatttgattgtggctgcaaaataagaatggataagtttaaagataaaattattggctacaaaacatattattttaatatgatattttctcaaaatacaaaaatcatattacaaaatcatattcaaatacgattttacataagaaagcaggaaaagttggggtataaaaaaagccctccgtgaaggagagcttagggagtgggttgttcattgtttcttcccgcgtaggtagtcgtttaggtctttgtaaccggcataacggttggactcgttatagacgcgtccatcatacatcccggctatggtttccactgtcttttgtccggcaaggtcattgtcaaggtaacagtggatatacgtgtatttttgcagatacgtcaatgtctttttcagattactgatcgagttcataataaggtggtcacagggagcattaatacaaatggcactatcgtccgtctgtttgagagtcagataggacagaaagtccatgaacccttcaaacaggcagacacggctctgtgtctcaccacgcgattggagtatcaaagaaatgtccttgttcttgatacatcctttataataagggtttcgcacctcgtatccaccggagatgttgccaaaagccagtgcaaagtaacgtcgctggcgcagttcgtaatgcacttccttacagaacattcgtccgatatccgaatcaatcatacgtgaatggagatatgagaacagtgcgtggtgtcgcagcggcacgataatcagatttttcatgtcggcttccacgggtcggaacgttgtgggcaatgtccgggttttcggtagcgatacaccattgacatgccgttcgatgtatgctaatgcttcactcacactttttgtttcgcaaaggtacttacccagttccacaaggtcgcctccggtggcctcgccaaaatcataccattcattcagccggtcattgactttgaacgatggcgtcacctctttcctgagaggcgaaagataccagtattgctctgatttcatatactgcgcacggtggccgagctgggccaaaaagtccacgatacgcactcgttttgcttcatctatggtcatattcaaattcttttcacttgtttgcgcaaaagcggtttagtttagtttgcgaccctatatatataaatactaaattaaactgaattatataggcccgcgcccgctctcattcttcatcgaaaagcatggtttctgcctgtgtcatgtcataataaaaaagtttatctcgtttgataaccagttttaaggtgtcagtcagatattgcagcagtttgaccattacgtttctcccacgcttaaatccgattgcctcgtaagctgtcatcatggcttgcagcatattttcaaacccacggataggtttgtctccaaacgcagcggaaagggcttcacggtgctgttcgacgcttagttccataaaacccgtccgctgtttcggtttctgatgtggggcattctcaaacaaatgcccttctgcgagaaccgggagcccgccctcattaacagtgaaagcaaagggtttaaactctttctcacggatgtgtaacgcatgaacctcgctgacgttgggacaatcgttgtttttgctgatgaccagtacagtctccgccttgttgctcatttccgtaccgatatgcccgcgcacattgttatctcctttattcaagtgtagcacacagtggatatgcaggtcatactttgatgaccactccatcatcttgttaatgacttccacggactcaccggtgctgtttatgtcaagcatcaggtcacggataccgtcgatgataacaagtccgtatccttttctttgacgtaaggcgtagtcgatgaccccaatgcgtattgccggagagtattcgcgcaagcaaataaagtcgaggttttcactgtcggttgtagtgggcagtccggcaagccgcaagatgcgttccagtacattatgacaatgaaagcggctctgttccgtgtccacgtacagaatcttacgtttaccttccgggaggtgcgcccggtagttcagcacttgttttcctgccagcgatgcagcgacaatggccgaaacgttaaatgttttttttgatttcgccttgccggttgatgcgctgaagttgccgagcgtagcaatggtcgagttgtctatccagataatctgtggcggcgtttcataggtgtccgtcgcccgaatctgcgaggcggagaggatatccgataagaaatcctcctccggcctcatatccacattatagtcagttcttctttcgttttccatggcgtctttgattaaagaaaggttgtgtggcagcggcctcgtttgccatacgtgctgcttcatctacggttggttcataattctgcaaaagccattcatccagatcttctttggcgaaatatatcattttgccacgtggcttgtaatgcggaatctccttgcctgatgttagcttgtacagcatactctcggatattccgatatacatacaagcctcttggaaggtaaacacctgtttggtggtatatatatttttttccagcaatgcgatgcgttccaacagactctctatcggatctaatttctttaggatggcttcgacgcttgtaagccgttcactcagccgttccatgaatgtcaatctattattttgcataaatgagttattataaaattagacaatggaagtatgccctccgttatgtagcgcgctaacggagggcaaagatagggcaacccaaaaggtcagcatgagtttgcaccgtgatagtaaccacgtatcacggcaactatcacgcttttacctttcacatacttcgcttattggcacttcttaccactctctcagttcatcaatggctcgcctgataccgtaacctgctgatgtcatgttgttgcgtagagcagacagagcggatgaaaggcttgaagctgaaacgaatccttttccgtccttggtttgtaagaaccgtccattactgagaacggtctgccatttggcttggatgaacgagtgttcaaggagtgtatcgaacaggatggccacatgacggatattgtttacacgaatacagaatccttccttgcaggaaagcagggcttccatatcttccacgtgtagggtagaaacgcaaaacagatgataagcattggcacaagccgtaatacctatcatctgtttacgagtgagattgcatccaaaagaaagaggataaatccttgtcgggccgtctttgcagcacgtgatggactgtgatggtggcacaaacatatcatacattcgtttcagttccatacacttctcgaacgagaagtctgcttcggtaaaaagtgatcggataagattggaacaatcgtttaataatcctttgacgatatgaatgttcatttcatggcagttccggcagaccgcatgattgcagtcgatataccggtggctgtttacaaaatcctccacgtaacggtggtactgcttactacccgccacgacatcacggagatacattgtttttgcttcaacgagcaatgcgaaaaattctttcgctacatcctgttcttcaacaaaatggtgcagatgtttcttccctccaaaaagagagagggccattgttaggtcttttcatgatgaaatactttaaattggatttataatatattataagggtgttgctcccgaaagaaaatcctgccggaacaacaccctaaataagtgtttagatatctggtctgatgctcatcgcattgtcaatcgaataaaccgttagtcagatttactgcatcgtcttttttcttattgacgattttggcatacacttgggtcatctttacagatgtatgaccgagcaatttagatacagtgtataaatctgctcccaatgtcagcatcattgtggcgaacgtgtggcgggccgtgtgaaaggtgaatcgcttggaaattccggcggctttggcccatggtttgataagctggttgatacctgaaggcaaatcgaacacatggtcgtctgctgtcttgtccccacgttccggcatccacttcaacgcttcattggagagcggaaggtaaatcggctcctttgtcttctgcatggctactgccaagcggtattggccgttgtcaataaacacgtccttccattgcaatccgataatatcactgatacgtagtccacagaagcaggagaacaggtaggcactttttaccccctcgttctgcattggtgtagcgattaataatctcacttcttcaatagtcatataagaacgcacactttccggcatcttgggcttctccgatttttccatttcgttgaatggattctttaagatgcgtttcgcgcggacagcggcatttaacgcaccgttgaatatctggtaataggtattacgcgtagaagccgagaggggctttcctttgggacggtagcttgtcaacatatagtcgatatagccgtggcaaaaagtgaggtcaatctgatttaatgtgaacctttctcctgcatactctttcaagatatcggtaacagattttatctgacctgtgtttttcttgccacgtttcttctgttcctccttatagagctgcatccagtccagcagataaaccttatccttgtgattcatgataccggcttcaccacttgtcaactctatgatacgcttcgatttgattgcatttgcggcagccattgtcgtttcattctgttggcgggcattacgatccgtttccggaataagatacattttcagatactcgtatgtccgcttaccattacggtatatatccagatacaaactcttgctgccattggccaattccttcgttcgaagacgaatcggctctttcacttttattggttttctggtccttggcatatttgtgtcctttcatttgttatttcctatcacaaaggtacaaataaaaagcggaatcaagaaacaaataagaaacaaaaatgcacctaaaaagagcaaaacaactgaaaacgtagaaaacaactgaaaataaaaaattgtatgtaaattattgatatatagctattttatctatatttatttggagcttgttttcattttatatatgtctttatgattattggaaaataagttcaataaaggagtgatgtttaaaaagtcaatagaacaattcgtagagcactacgaaatggtaggactggtacaggaagaaacgctgatgagggcatttcaaagatggaggaaattggtgaaagaagaaaaagctataaaactataatgaaagtatattgattttgatttaatattccataaggaaacgtgatatactatactaattaattggaagaaagaaggaacttttctatctttgctaatattaatctttttcgctaatggattaagataagaaaggagaaaataatatgaccctcaaagaaaaacaattagagtttattatctattgtatagagaatacagctgaacggttaggacgctatagtgcggatgtatataataaactaaaagaattaggtgctatagacggctatataaatgctttttatgatactttgcatacccaaggcaaagcctacatagtagattctttattagaatatatctatcatcgtgatccacaatggttaccgaaagattatcgtccttttcaagtttcgacacagcaaaaaggagataagtcatgttaactgtttatcatggttctacttaccgtgtagaacaaccattagctggagtatgccgaccaaatcttgatttcggagtgggcttttatcttactgatttaaaggatcaggctattcgttgggctcttcgcacagctgatattcgccatgaaaaaagtgtatggctcaatatttattcattggatatagatgcctgccgtaactcttcttttcattatttgcactttaccacttacgatgcacattggctggattttgttgtagcatgtcgacaagggaatgttatatggcaggattatgacataatagaaggcggtatagcagatgaccgtgtgatacgtactattgacctttatatgcgtggtgattacactcgtgaagaagcgttgtcacgtttgattcatcaagagcctaacaatcaaatttgtattacgaaccaaaaagtaattgatgaacacttacattttgtggatgctatacttttgcctttcccatctctctcaaaagaaatccccaatgctgatattgtaatgcaaggcaaatattacagcattgtagaacttcttgctacccgtctgcatatttccagtctacaggcacttgatatattttataatagcgaaagctaccagcgcattgtccaccgacttggagatctatatctcatgagcgatgcatatattgtagatgaattgatgagagagctacaaaaaagacaaggttgatattagccttgtcttttatccctattgttaagctgttcgagaagtcttcttccgatgaagtagttaggccatccggatcggtgacagtactcatattgtgaatggcaaagaagacattaagaagttagcgaaaatttataatatgagtgaacatctactaactttttcttgtttttttctataaaaaagaactactttaggtattataccagtattaatgactacatttgccaatagttattcttttatatgagggatataacttaaattttttaatgagcatggcacatttaattgtaacagattttggggctataaaatccgcaaatatagaaataaagaaatataatttctttattggacatacttctagtggaaaaagtactattgcaaaacttcttgcaatatttaacaattcgattttttggactattaaagaaggagatttcaatagtttcttaaggttattggataaatataatattaattttgaatttacgtctacaaccattatttgttatagcaatgaaaaatactattgggaaataggcttaaataaatttcacagtaactacgaggatgctgatttgatggaaatggctaatacttcaaagtcatatgattttattttaaaatttatagaacgaaaagaaaataactttgcatacaaagaatttatcaaaagtcttaaaaacctcttagatttaaaagatagcgcaatggtagagttaataaaacctgccttagttggactcctttatgaagaatgtataccagtatatattccagctgaaagattgttgatttcaacattttctaatagcatattttctttacttcaagcaggagctagtattcccgattgcataaaggattttggtagcttatacgaaaaagcaagaattcagtataagaatattgatataaacattcttgacattaaagtgtcattcaataacaatggtgacacagtatatctaatgaatgaaaacaaagaagtaaaactatctcaaacttctagtggaattcaatcaattattccgttgtggattgtatttaaccaatatgttgaaagcaagaaaaaacagatattagtaatagaagaacctgaattaaatttatttccttctactcaacacttccttattgattggatcatgagaaagatgagaagatcaaatggaagtattgtaattacgacacatagtccatatgtgttatcagtagtagataatttaattttagcacaagaaatattaaagaaaagcaataaaaagaagttggtgctatctaaaattaaagaactcattccatcaatggcgctaattgattttgatgatgtatcatcctacttttttcattcagatggaactgttaaagatataagagatactgacataaaatctttgggagctgaatacatagatacggcttctgacaaattaggatatatttttgacgaactatgcaatattgaaagaaatgagttgtaaatgttttaatagaagattcgtattcaagaatacagattcttttgatcataaatatgttaattcaaagtgtaaatgcacttctcgttttacgatttgtgaaaataaaagtaagttcactattgcatctaaagatatttccgaagttgataaaataaaaattgatggttattttgatagttcatcagagcatagaaagtgtgattacttatttgtatacacatcaccccttaattgtgtttatatttttgtagaactaaaaggaacggatattgcacacgctataacacaaatcggcaatacagtgaacttattctacaatcaaggatatctaaaagataaaaaagttataggagctattgttagttcacgacatccatccaatgacggtacgtatcgtaaagcaaaacaaaccctagaaaaatcactttcatcaaaaataaaaagctttcgtatagaaaagaagaataaagaaatgacatacgatcctattaatgataaagttatttaagggcatcgtcaattcgagatacaaattgcggattgctgggacgtgccgtagttccgaaatctacaatttgcccttttctattaatcaacagataatagggcattctatctattttccattgtttgcgaattttctgtaagttctcttttccaaaataatcagatgcataaatacattcaattccccggtttttcaatgaatactcattcaggcactcttcccattcctccttgggttcacttacacatatggagtatatgaccaggtctttggtggaatacttactccgcaattgtttcaaaggttccatttctgccaggcatggtggacaccacctagcccaaaaatcgaaatagatcactttcccgtgattcttctcaagtatattatagacgggttccatgtaaggcatagatgtttttagctttgagttttcgtgaaactcaccatataataaattattggaaactggttgcggattttccaggtaagatttagtctgattatatatctgcatcacttgtgcacgcaaatgcggcatttttacgatcgaatcaaactgtgtatgcctcgttgttaaagcaagtgtatcatttgcattcaaagagccaactgccattttagtatatatatactggttcagttcattctctcctactgccgacataatctcttctacagatggattttttttatctttgtatgttatcccataagctatataacgttctacctcatcggcaatatcatataaacgtgccgaaagaatccctttattataaagtttattgatcgcaggcagaagtttatgataccgatccatttcttttctcgttttaaactggcattggctgccatagaataacaaagcgtaataatagtcctgtttcagtaactcttcagtaaataacgtaacatcttccattggtttatactttgtcagatactcgtttcttcgctccaaacgaaagtcatattccttctttaattcagcctcaaaatccttaatattcaaattcgggtttatactataattctgtatgtaatagtaggcgctttctgtaaatgccagtatttcttgattcaacttttctgcatcacctgttactttgggatgaaaaagatctttgaagtctatttccacgtgtatgctatctcccgggtggatatacaaatgttccgcataattgcgaatggaaacttctcttaattttgcataaaccggaaagcggaatgaaaatgagccatcttcttgtatgggggtgcgatattgattttccattttccaaaaaaatggaatgatgagagttaattccttttcttgaggataaaaatcccggttcaacacttttcctgtgataacagcctcttttatatattctttcgctaacgaataactttcttctgtctgtacagatgattcgaattgagattttgcccggtctttttgcccgcatccggctaataacaaagaggttattatcagaaaggaataatagtgtttcatcgtgcctgaatattagaaagtttgcaaatctaaataaataagagttcttgctcctaaatatatgaaattaattttaggggcaaaaactcttgatagacaattcgtctcaattttaaatcttttacaatatatacatttaatttgcgagataaacagacaaagctataaccagcgcacaaacttcctgatataccagttcttcacgatctgcgtcaaaatgcaataagagagcaaaattccaaccaaccaggggaaatagctcaaaggaagagctgtcaatccgatggaacgcccgaaagcggtgaaaggaataagaatacctattgccatgattaagaaggtcagtcccattacaggccatgtggcacggctttgtatgaacggtatcttgcgggtacgtatcatgtggacaatcaatgtctgtgataacaaaccttccacaaaccatccggtttgaaacagtgtctggtgttcggggctattgcagctaaatacgtaccacatgaccagatacgtgataatatcaaagatagaactgatgggacctacataaatcataaaacgacttagatcggacgcatcccatttacggggtttcttcaggaactccgggtccatatggtcaaaaggaatggtggtctgcgatatgtcatacaacaggttctggatcaatagatgtatcggcatcatgggcagaaacggcaggaatgcactggcaaacatcacactgaacatattaccaaaattggaactggcagtcatctttatgtacttattgatattgccgaatgtctttcttccttcgagcactccgtcttccaataccatcaaatctttttccaacaagataatatctgcgctttctttggctatatccacagcagaatcgactgatataccaatgtccgactgacgcaatgcacctgcatcattgattccatctcccaagaatcctaccgtattgccttgttcctgcaacagagagatgatttgcgtcttttgtaatggagtcagttttgagaataaagtggtatcctttaccgcttctttcaatgttgtttcgtccatattttctatttctatccccgtaagaaaatgactggtgtcaattcctacctgtcgtgcaatcgctttcactacaatatcattgtctcccgatagaattttaactgctactccatgcgcatataattgttcgatggcttcggcagcagaaggtttcggaggatcaagaaaagcaagatacccgatcaataccatttctttttcatcttcgatggcgaaattacaatctttctcgataaaacttttttgggagactgccaataccctcatcccctgctgattcatatcttcactaatcatctttgctttgattttcaatgcatcagtcaagggatgaatctgcccgttgaactcggcataggaacagacatcgagaacctcttctaccgctcctttggtgatgatttgccgctttccctgcctgtcttctattacaacagacattcttctgcgcgtaaagtcgaaaggtatttcatccactttggtatagtcatccttcagatgttccagactcaaatctcttacatgagaaagaatcgctttatccatcaggttccttaaaccggtttggaaataactgttgaagtaagcatgacgaagaatacgtttactgttgtcgtcactgccatctgcattgatatatttctccaatacgattttatcgcaagtcaatgtaccggttttgtcagtgcagagtatgtccatcgctccaaaattctgaatggcattgagattctttacgattgttttctttttggacatggctatcgctcctttggaaaggttggcagtcacaatcattggtaacatttccggagtaagaccaactgcaacggatatggcgaaaatgaaagcttcaaaccaatcccctttcgtaaagccatttacgaaaaacacaaatggaaccataaccagcatgaaacgaatcaataagaagctaaccttactaatgcctttgtcaaaagctgtagtggcacgatgcccgaccaggctctttgcaatagtacccagataggttttgttccccgtttcaaaaacgattccttttgccgcaccacttatcacattggaacccatataacaaatattgtccaacttgatgacacttcctttccgaaactgttgtccccgtacctccggaaacttttctatcggttcggactctcctgtcaatgaagcctgactgatgaacaggtctttcgaatcgatgatccgaatatcagcaggaaccatgtccccggctgccaaatacacgatatctcccggaacgagttccgtaatttcgatctcttcttcatgctctcccgcacgtttggcaagacatgtgttttttaccattttcattaaagaatccgtagcctcacttgctcgccattcctgccaaaaacgcaggatagcactgaacagcaccatggatgagatgatgatgactcccgtccattcctgctctccgggatcggccatcaatacatccaaaaatgaggatataatggcgagcccggtcagaacgccaatgaaaggattgataaacgttttgataaacaggataaacggattctttttctgttcatgcaccacttcgtttcttccataaacggattgtcgctcctgcacttctcccaacgttaatccaagctttgttgtctgtaagtatgaatagattgacttaccgggttgtgtggcaaccaaaaatactttctctgaattgaatatgtactgtgatgaacgcagttttttcttccataccatactctctaattttttttaagttactaactgcatttgttaattcgatgcaaaagtaaggaagacttcaccgggaagctgttagagaatgattagagtggtattagaaagctattagaatttcttaaatatgcggaagtttcaccacaaaagtagtgccctcatccttatgggaagatacggtcagttcgcctttgtgaaggtggataatcttctgtgtcaaggccatgcctataccatttccaggagcaatatgtttgttctctccacgataaaacagtttaaacaggttttctttatccgtatcagacatacctacaccgttatcagacaaacgaatgattgcccattgctcccaataggcgatcaggactgatgaagcccggttggaagagtacttgcagttattttctatcagattcacaaaagcggtggtcagcaaatagctgtttccgattattgtcagcacattatcttcttcggcttcctgctcaaatactaattcgatgtgataatccggatgagcttttagtaccagctctctggcgtccagcaacagttcgtccagacggacttcttccattgttatctgttccgactgatagtcagcttttgccagattcaataatccgtcgatcagattaacaatccgacgcgaatcttgcagtgcattgccgatagccatctgatattgttcggagctccgttctttcaataaagctaaatccaattcggctgtaagagctgccatgggggtacgcaattcatgagatacattactgacgaacatcttttgtgaattgaaagacttttccaggcgttccaacaatgcattgaatgtcgtactcaattctcccagttcatcctgttcattttttacgggtaatcttttatcaatatgcgatgctgtgattttctccgcttctttcactatattacgtatcggttttaaagtgcttcgagaaaggatataccccacaaccactaatacgctcaatccaccgataaataggagaataagcatatttcttagcgcatcccggttggcgtatccgtaaccgtcgtaggctgcggcggtaaccacatagtctttgccctcaaacggatataccagtcctatagcctgatattcgtccacatagaaattgatgttcttccgctgcaaaatacgctttatcatttccggcgtttctttgacaatatcgttttgcagagcatcgtgatataatattttaaaatctgttgtatagacggcaacctctacttcattaataaacttctgattattcaggtaaatagactgcatggttttggcatctacttgatccttaaggaataaatgtgctttggttatagcttcactttgaagattacgaaagaaagcattgctacgcgaatgttcacttacatagtagacagccatcacaaatacgaagaataccgcagctgtaagccctgcatattgtagagtcaacgttgtcctgatcttcatattttatcagtcagtatgaaacccattccggctttggtatgaataagtttcggttcaaaatcccggtctatctttttgcgaagatagttgatatatacatctatgaaattcgttcctgtatcaaaatgggtgttccatactttttctgctatttcaaccctgctcaatactctttcggcattttctaccatatataacagtaagttgtattccttaggagaaagttttatggatatgctgtttcgttctacgtctttacgttgaaggtcaatacgcaaatctgcatagacaagttcctgcggcaattcctgtgcattacccgccacacgtttcaacagcactttgattctggcatttaactctctgaaatcaaaaggtttcaccatgtaatcgtctgcaccggcatcgaaaccgtccagtttatcgttcgtcgatcctaatgccgtcaacatcaatatagggatatggggattggttttgcgaatttctttcgctagttcaaatccgtccatcttaggcagaacgatgtcggatataaccagatcgaatgtatgcgtctgaaaaagccgtaagcccatcagtccgtcataagccaccattgtctgatagccattttcctccagtccgttcatcagcaaacttgcaacccggggttcatcttctataattagtattgtgtacataggaaagaattcattaatctgaatgtataaaacgaaacaaaaataatgattattccccacttatagcctttttccttgaaaaatcgatgagaaggccaaataaaaaaggtatccaacgcaatgtggatacctttatatgattcatttacataaaccggaaaatgactcgtccggtttgtggaccatttacccatttcggttgtgaagagggaccacacaaatcggtggagtttactttattacgtaccggaggaatcacgttcaggacagagattccgctttcgggaagagtataaagtaaacggtcgcggccatcacgaggctgatatactccgatatatgcgtcgggagtttcgtttgtcaggctgatagtgccttctttcgtttggatattcatccaggaaacatcaccaaagtatcctttaaattcaggatatgtgaaagtctcacccgggataggatcgttatagtcgttttcccatacatcgtattgtgttccgtgaatacggttttgccatacacggtaaggtccggcacccagccagcgtttgctgattacctgatcttcaggatagtcgaaacgaatacccatcaagtctacgacaccggagaaattgtaggtataatccaaagccagttctccactcgggttaattgtccattgggctttatccagattgcctagtttataattggcggtaacaaccagattacctccgtcttctttcacatccagtttcgtaaatacggcagcatcagggaattcgctgtatgtgcggtctttttcttttgctttctcatcatcatggttatagaactgatccaatgagcggtctgcacgacgggctccaatgaaacggggaccattggcgaagttaatcttacggttatctacagatacccctttcagttgtccgtctttctttgagaagatgaacgtacgcttattcgctttcacagtaagctcattttctgtctctgtataagcaggacgactggacaagggagaaagctgttctgtctgctgattcagtttgttgaccgggaaagtccagcgccaaagttcatggccgtatgggtcgattgctgtcagaaagagggcgtctgcattggggaggatatttgtttttatatccaaaatgcctgccgagtgagcaaccacgtcactgccttgcacttcaccctctttcaacacttgaatagcagcattggacgcatctgttgccagcgggaattttacttgcttccaaaggaaacggcaagtattcagattcagataatcgtaacggttttctatggagaatttgccatcaaattgcttgtcgatagaagtattcaagatttgtaccggactccataactgcttgatagtgtagtagctaccctccttttcgtgatgtggtcctacaataccgtctgctccaaagtttccttggttatcaatgaatccgtccatatctacacgcttcacaccttcgtctgccaatacccaaaggaatccaccgatacaacggggatgcttgcgcatcatttcccaataatcatataatccggcaccatggccgccatcgtacaaaccatgcaagaattccgtaggcataaagatttccggtaagcgcatgtagttctggctttctccgtaagagcggtaatgcatggtttcaaaaccggagaagttaccttgcgggtgaataaccggacgtttctgcggatcgtatttatgaaactctccatccagttcggtattccatcctttttcattaccattactccaccaaataatagacggatgattcacgtcacgttctatcatgccttcaatcagacgtactccggtgggggtatcatacttgccatgccagcctcccaattcatccatcacataaagtccgagagaatcacaggcttccaaaaattccgggtcagccggatagtggctcaaacggacagaattcatattcatgcctttcatcaaaagaacatcttcgatattcttctctttactcaacgtacggccactttcaggacggaaactatggcgattgacaccacgtacattgatacgtactccgtttatataaagtccgtcgctttcgcgtacttcaattgtgcggaaaccaaaattttctgtttcactatgcaaaaccttaccggtcttatccaatagagagaattgcgctttataaagattcggagtttccgctgtccataatgcggggttagatacattcagttgcagggaagtccagtcgcctcctgcttttacgggtacggtggtttccgttatctttttcccttttttatctaaaatctgtgtacggatgctcattccgtcattagagatatttgtgtaacagttggctcggaaagttccatccatctttgcgtcaatggcaatgtgccgcaggtttacggctggtttcacctccaggaataccggacggaagataccgccgaaattccaataatcagcacgacgttcggcaaggttcacactggcattttcactctctttggcaacagtgacttccaataaattctttttgccatatttcaggaaatccgtgacgttgtatgaaaaacgatagaaggctccctgatgtttggaacccactttgcgtccgttcacttttacttccgtatctgtcattgaagcttcgaatacaagattgacctgtttaccgcgaaacttttccggaacttcaaactcgtacttatacatacctttttcatcggcaacgccttcaggaaatggttttccatagaaagtgatcccatactgataagtgccgaagccttgcaattcccaacaggaaggtacgccgattttcgtccatttgccggaattgcgtccgttggtacaaaagaagtcccattcaaccatatcgtcgcatccgtgaccggagagatattgcctttccgtttgtggaaggttttgagcagccagggtagttgccaacgccaaggttgataataaagtggttacttttttcattgttacttttattattgtgttagttatttattgctatcattgtttactactgatgcggagatgcagcgtatgttcttttttctctatggcatatttcttcaatacacccggtccgcaactactgtttcctaatccaagtacggcagcatccatactaagaatgacttccgcacgtggttttaaatcgcaatcgtgagtttcttcatagatgtcttgtacggtgtaatgcagggcagatgcagaaaatgcgttttctaccgcgtcaacacgaatgcctttattctgtttgtcggtcaaggtaagataatgcacttcctctttgtttccactgtcctgcggacgtggataatgtacgtattggtctgcaacacttcctttccaaagccctatcatagcagatgttttgcggtcaggatagttatcctgtggtcctctgccataccaggtaaatgtatcataagcaggcgccagacagaatgcgattcctaaacggggaatttcaggaagaactccttgtggcaagaaagttgttttcagatcaatcgttccatctgaaaagaccgtatagacagaagtcgtcaccacttttccttctttatataaattacttgtttgaatccggacaatgaccgccccgtctgcacgtttttcatggtggaaagattccagatttatctgcggatgatccatcccatgcaatttccagtctttagccaaccagtttccgaagctcttgtcattatctgtcggagcacggaaaacttgagtgacaggctgaaccggaaaatcatcggagtgagccagcatttctttgtccttatatataagggaagtcatacttccgttcactttcttttcccactggacagaaaaaccgtgcccactaatcaataaagatttatcatcctctttcacctgaagcgctcctttattaattaaatcggcagaagctaaatctcctttctgcaagcagaattgttcccaggccacttcatgtcctgcctttgcccaaagagcatccgatttcaaaacaatgcttactttcagttggcaatcggaaagaggtttcaatgaacggaaagccggcaaaccgattgtgccactttcccctggagctatttccggcaatgttatttctccccgttctttctccttaccatccactgataatgtccacagacaacgataaagtgataaatcagtatgatgattccggttggttactctcaactctccattctcaactctcaactcaaccggtgcatatactttttttacctcccaatatttaggcgtagtttcacggtcactcatcagtaatccattaaagcagaaagcttttaaattcggcttatcgccaaagtcaccgccgtaagccaccatggtacggccatcgggtaatgtcttgtagattccctgatctacccaatcccatataaaaccacccagcatacggggattgctatatatctcatcccaatattccttgaaatttcctaatgcattccccatggaatgtgcatattcactcgtcattaccggacggtcgtcattggtacgctccgcaatctccagcaaccgctcccaacgtgcattttcagcgcgttccttgtcctctccctctgcaatgccgggatttaagtattcctgtttcacccgggtataaaagcggctgataacatcgaccgtcttcgggtcaggatttccgtccactccctgcgccccctcatagtgtacaggacgagtgggatcgaaatcatgcagccatgccgaaatagcagcgaagttcggtccataaccgctttcgtttcccatgctccacattacaatacatggataattcttatcacgttccgccatacggaccgcacggtccataaatgctgcatgccagtcgggggtacttgcgagtgttccacgcaatccgtgttcttctatatccgcttcgtccatcacgtacaatcccaagctgtcgcatagctcgtaccaacggcttacattcgggtaatgactggtgcgcacagcatttatatttgcctgcttcattaaaagaatatcctgaagcattcgttcttcgctcatgacacgtgctgtccgtggatcatgttcgtggcggttcactccacgaaaacgaaccggattaccgttcactaacagttgtccttttttaatttctacagagcggaagcccacggcctgttctatctgttctacgacttttccttctccattttggagagttaagtgtaatttataaagatagggtgtttctgccgtccatctttccggcgattttataatggctgacaaacgtcccatcttacgcgggccacgctgcggataccattcattcatccggcttgctttatgctccaaatcaagaatatcttccacattgcctttcaatgtggcaacttctttgcctgaagcatccttcaatactccctgtaagacatacccttttccggtcatccctcgatatacactgaattgcggatcaatctgcaaaataaagtcttcataatcaccagcagatgcaggaagagtgcgtaccgcataatcacggacatgaatatccggcgtatgtatcagatgaatactacgatgaataccaccaaaacgccagaaatcctgatcttccagataagaaccgtcactatatcggtagacttccagtgaaatttgattttctccggatttcagatacttcgtgacattaaattcactcggttccatactgccttggctataccctacccgttcgccattgatccaaacataaaaggcgctcattacgccctcaaatcgtagaaaagtcagtccattcgcttcccatccggccggcaagacaaaggtacgccgatattgccctaccgggtttcgttctttatacgtggtatagtcagttttcggttctcccatcacccgtggaggatctattttaaacggatagcctgctgaaacatagataggcgtgccatatccgttcacttcccaattggcgggaacaggaaaatccgtccaatctttatcattaaaatttgtttgatagaaattcacgactctttcattgggaacgggagtccaacggaatttccaggttccgtctaaagagattgagccgtctcctttctgtacagagaaaggggtaaaagcggctcttgccggttcacgattgatctggagaacatgataattctcccaatcatgcattgtttgtgcctgtgtaggacttacaaacaatgcgccaagcagtaaagtatatattttcattcgttcttttttcttcatatcaagtagacggacgaaagggtattttgtacccctttcttttatagaaatattaaagaacaataaaaggagtaacactctatgaagaaaatctttaccttgtggcgtataattaattctaatattatgatgatgaaaaaactactatttagcagcttttttttattaggcagtctcgtttcacaagcacaacacgagtacacaattaaaggtgaggtaaaaggagtgaaagacggaactcatgtttccttatttttgacggatggacgcgtaggaagcatagttggtacggatacgatacgtaatggaactttctttttcaagcgaaatgcaggagaaagcggtatggatcaactgtctctcatgtgtcgcgatacagatttccctccaatgtcgttagatatttatgcaactccgggcgcaaaaataaaagtaacgggcacaaaccctctgatttatacatggagggtagatagtccagtaaaagaacaacaagaacataatagattcattgaggattcccgtgacttatgggacgaatttcaacgcttggctatcaaagaaagaagtatgcgttcagcttcagaaaccgaacgaaaagcacttcgaacaaagagtgatagtatatcttccattattaatcaacgggaattaaagttgatgaaagaactccctatttccaatgtctggatggaaaaattactccgtttgagtatgtctttgaaatacaatccaaagtttaccaataaggaagaaatactggctttgtatgacagattgaacgaagagcagaaagcttccattgaaggacaagaaattagggttaatctcttccctcctaaaacggtgaaagaaggagatgacgtggcagatgccgatctttttgatttagatggaaaagttcatcatttggctgacttcaaaggaaaatatatgttacttgatttctggagcagcggttgtggtccctgcatcatggctttgcccgaaatgaaagagattcaagagcaatataaagaccgactcaccatcatcagtttgagttcggatacgcaaactagatggaaagctgcttctgcgcaacatgaaatgacttggcaaaacttaagcgacttaaaacagactgcaggactatatgctgtatatgacgtcaacggtattccgaattatgtccttatctctcccgaaggcaaaatcgtgaaaatgtggtcgggctatggtaaaggcagcctgaaattaaagatgcgtagatatttggatgcgccaaagcgtgagatgagtatcaccggggacaccaatagaaaagtagttaactatccaagttttgaatcaaccaatactgatattcttgaagtgaagcaggtagaattgactgatacagccactatcgttcatttttatgcatattacatacccaaatactggatacaagtaagtgtaaatgccaaactagtagacgagcaaggtgcatcatacacattacaaaaggctgacggcattacccccggtaagcatttctttctgcctgaaagcggagaagccgaattttccctaactttcaaaccattacctctcaaaactaaatcattcaatttcacagaaggaacagccaaaaacgattggcaaataaatgggataaagcttactagataaagaaaaagaaatgtgccaaaataaaatcataaaggagttttggcacattctctctattaatatttgaatatcgaatattaaaataagaatattgtattaacattaaatatcttgcaatttaaaataaccgtataagtcgctcaaaaagagctgtaaatatgttataatcttcacagaaatggttttctttgttataagatatgtctcatatatcttatattcagtacaaaacaataaaagaaatggaagattacaaacagacactctataacgatgaattattaaacattttacccgacggagtgattatatttgatacaaatggagaagttatacaactcaatcagcaggcttttgcagaactgcatgttcatccgtcggtcaatgatatgcttccctttcctaccaatcgtttatttaaactgctaaataaaaaggaagatatactttcgactattctggaaaagattcgtcagggagaaaatacgtattcattacctgaacataccttcatgcaagaacaggttgattacacacaatttcccataagaggagaatttgcaacgatcagggatagaactaatttaaacaagatcttattctttttccgcaatattacagtagagcttacacaggaatatattctgaatactgctttgcaaagaaccagaatctatccatggtattatgatataagtcggagtgaatttactcttgacgatcgttattttgaacatttaggtattccggcaggagaaaataatactttgacaatggaggagtatgtgaatatgattcatccggacgatcgacaacctatggctgatgcctttgttgtacaacttagtggtaatacaacttttgacaaaacagttccattccgtttgcgccggggagatggtacttgggaatggtttgaagggcagtcaacttatattgcaaacatatccggccatccctatcggttagtgggaatctgcttgagtattcaggaatataaagacatagaaaacaccttaatcgaggcacgtaaaaaagcagaagaaagcgatcgtcttaaaatggcgtttctggctaatatgagtcatgagatccgtacgccgctgaatgcaatcgtcggcttttctgatgttataggttccacttatgatgagttaagtgaagaggaacgtgccgatttcgtgcgactaatcagcatcaatagcgaacatttagtacgattgattgacgacatacttgatttgtccaagattgaatcaaatacgattaaatttactttctccaactgttcccttaactctttaatgatggacatagagaaagaacaggcaatgaaacctatttccgaaattgaaataaagtcattattaccggatgaagatgtttatatcaacacagatattacacgcctgaaacaagtaatatgcaatttcattaataatgcccggaaattcacccaaaaaggatatattcattttgggtatacgcttgataacagaaatgcggattcagtacaaatatttgtagaagataccggttcgggaattccgcaagaatgtttgaatgaaatctttgatcgtttctacaaagtagatacttttaaacagggaaccggtttaggactttctatctgtaaaacgattgtagaacatctgcaaggagatatctccgttaaatcagagattgggaaaggtagttgttttaccgttacattaccatttgatagaaaaacagaagattagcgtcctctatattcttgaggggtaataccagtatgctgcttaaaaaacttattaaagaaggagatattattaaaccctaaagatagagctatattttttacaggttcatcggtcgactttaaacgggatttagcttccatcaaaatgacagaagcaatcacctctaatggagtatttcctgccgcctttttaattgtagaacagaaatggggcaggctaagtcctaactcatcagcatagaaagatgttccgtgatggattgtataatgtttcatgactaattttaaaaactcctgataaatctcatactttcttgattgagaagacaaataccaattattctgtaacttatatatttctgtagccccttggataaacatggtaagaacagcttttactatctccttattttcgcgcgtcctaagtgaagcgtatgaaagaatagatgattcataaaacattttataactacaggcctgaagtggagataaagcaactattggattctccataattaccggaagaaggtgctgggtagctttcatcaaatttatactttctataaaatgagatgaaaagcctgcataataaatctggatatcggatgagaatgtgtgcacctctaatatgcaattaggcggcaaagttattaaatcattttcactaatatgatgggtattggtattgatcgtcacctccatagtgccttttatacaaagaataaataagccggattcaatcttacatggaaaattcttatagctcttcagtaaatcttttgcgaatccctctcctacaatataatcaaccggcaaatcatactttggtatattactttccattattgctctttttgtttgtcctcaaagatagagattatttaattcctatcttttaaataattaaaatcggaacattgaatcataaaaaaataacatctatattctatttctaagaaaatgatccgaatataaagaaacgggatgcggaaagtttaccttatccgtatcccgttttattgaaatcaattgatagaaagatttattgaatatccaatgcatcaaaagcaattccgtccatattttctgccgaaagtaatactttgtaatgtccggcattgataaaggttccggtggtggtgctcatcatcttccatttatccggtgtttccgggaagctcaatacgtcctctttcaatacaactccttttgagtcaatgaattccattaagacaggtattggctttccagtagtgttcatatatttaaagcgaagcgcgtacacttgcgccaacccggtagaaacattccattcaatactgttgccttttcctttaccaaaaaacactcccatctgtttgcgatgttctttcttttggaatttgcctttcagcactgccgtttccgcttcgtatgatatactgacacgagcatttttgtcttccggaagtaactctttcggagtcttttccattacttctttatccgccttttcccaactccagccggacgcagggaataccgtcggtttcagttcccgatctgtgctggcaatagcaatgcctgaaatcaaggcttgtcctgctttcacttccgggaaatgaattttcaacattccacccttcactgtggcatataccaccttcttacaaactccgtcgtgaccgctttcagcccaaatatccaagtcgtctaatacaacagaatcattcacggcaacatcaaatatgcgcagcccttcacagtcggtagaagcgcttccgcccgtaccatgccaaggctctgtgaaatacagttcaatacgatatgttccgtctgccacagggaaacgatattccagctgatgacgtccgaagcggaaatgttggaataacgtccagtcacgagtgccgcgaatcggatcattggtggtacgttgactggcaagataaggattcaggtccttgaaattctccgcccatgaacgggaataattcgtattgtcctgcaaccataactgtccgaaactatctgtataatcatcccctccacagttgagacgatacagataattatatcctgcctctcctttcaatatctttttatcatcctgataaagaagttcgaagttaggggcttgttccaggccattcaataggatcaggtcttctgccaccggtttacctttataatagcctactgcacgaagcacgttataacgaatatcccggttttcccacataaaatgagtgcctgttccgttgttctttttacgtccgaggaaggtttccttttcatttgtcagatcgttgtatagcaatacagaatcacaattgctgtaagcctcgatagtggcacggcgacgtcctttttcaaagcggttggcccatgtatgtgataccaggtaaaccatcgggtcttttgcagccggaacatagttggcgcgatacatataatatacgtccaacggttcttcccacggagtaaccaatcctttataattgaacggacctactttatctatcttgcgatacgcttcatccggttggcggcgtccgggattgtcatgactgctgtatatccattggaattgtccgcaaacactatctttagcctgttctgccaaacggattttagtttccatcagctgacacatacggtcttcactccacactccgttcacctggaaatctcccggctccgtatgtaggtcgatgcttctccacgctccatattctccgttcaacaattggtttgcttgagagagctcacgaccgtatttcgtcacatctcctccatacgtaccactccaattttgaatcacattccagtctgtaccctcaccgccattacaggttgttatgacacgcattgtctttgcagtcggatccatctcccgaataatatcactgcactcctgtgcaaactcacgaggcaaagtgctttcattctgcaatccccacatcaccactgacggagaattacgacgttctttcacccattgacgaagcaactttttaaagttctcacgaaactccggagtgtcataccacacgtgggcggaaaattgtgtccaaaacaagattccctcttcatcccagtatttttgataatcgagatgatggggctgatgagcatcccggaacgcattgaaaccggctgcacgtatctgttttacccttgcggcaacctgttcattactgaacgcatggctttgtccgaactgatgctcatactcacatactccattgataaacaacggctttccattcaggtaaaaacgtccgtctccatcgtttcgttttaccggccagctaatggtacgaataccgaagggtgtcgaaatttcatccgttgtcttcgtatcgcgcttaatcatgctagccaatttatagagatatggattttccgtattccacaagacaggattctcaacaggagcctgctggcgaatcactttcatttctcccggagctaaagttactttttcaaccaaacggaaaacttgttttccatcggcattgcttagtttattgactaactctaccgtttctgttgttttactataattcttaacctctgtttctacaaatacgttagcagccttttcgtcattccaaatatgtacaccgaaaggttctatgcgaatctcatccgttacttccaataccacaggacggaagatacctaacggttgggaaccctcactgaatccccattccgatgaacatcctccacatacccaaggcatatcggcaatcatttcaggatgctcggctttcacttccaggcgatttactccctgtttcaattcatctgtgacatccaaagtcaacgtagtgcgccctatgggatgacgaccgaagtcctttccgttcactgtaatggtggcgtatgtacccactccttcaaagcgaaggaaatattttttaagttgagagttgagagttgagaattgagagttgttgagggtgaagtcctttttgtaaagaacggttccgtgaagattgccatgagtcaattgacgatacccataataatcatcccagttatgaggtatattcacagtcttttcactctcaactctcaactttccattctcaactctccaagttttccagccttcatttaattcaataatttgccggcggttcttgatttccggtttcgggaaacggacagccgaacgtcccatcggcttactggtagcaatggcaatgccacgttgctctgcgttgtttaccgcacaatagaaatgataaaccactccgtcatgtttcaccacatagctcttatgagcaaacagttcatcgtagttcttggaggggataatcaggtcggcccctttccagtcggtccagttcactaaatcatagctggcggcaaatgtattgaatgctttatatttacgcgaaggttcaaaagcagagaaataaaacatcacatacacatctcccatcttttggatatgcgcatctcctgtaatggttccatcagcttcatgcgcaaagaccggatttccggagtagcgtttccatgttttcatatctttggaaagcgcaatgccgacacgttcgccctttaaattcgtttccggatgatgcccgcccgcgttgtaatacatcacaaacggagctcccaatgttttatctttatcccaataaacggtactcttatattgagtcagcttttcccaccattgggcatctttatcatggatgctcaaaatcggtttgtccagagattcccattcatgtgccgtagaaatatctcctttcgtccatgccagtccgacataaagcggagcttttacagcttcgtagcctgttccttcaccgccgatataagtcatccaatggcgacctttataagtctgaagctcatagcttccaccccattccatatccggcaatgcaggaaatccgccacgctgattgcagtcccattttccatcccgataagaaagaacccgtcccaaagtgcgccattcgagcaaattatcactttctgctatccacgtttcgtaaccacgaccatcagttccacctttgccgttgtaaaccacataagtcatcagccacttgtctccctgacgaaaaacggtaggacaatcaatcttatgataattgtctgccggggcaactgcgagcccgtacttgtatggtgtctttacttcctcgtaaatctgctccattcgttcctgcggaacttccctttgcgcatacagagagaaagtggtggctatactaaaaactgccagcaataacttcttcatgatactttttctaatcgtttaatacttaaatagtgcataaccactaaatgataattttgcggagtgccctgaaagggtttaattatatagcgtagggcaacgccctacgaaaaaacggtaatctgaatttgcgccctgaaagggcataattgtatacagttccgccctttcagggcttgtggctggtgtgtttttttcgtagggcgttgccctacgctatataattaagccctttcagggcaccccaataaatatataattgtaaggctttcagcctaaccgataaaatctcatttaaccgataaattcccatttaactgctaaattcccattaataaaacaaccaatccattgtctcttcatccccggcaagcccggcattacgaactttcgtttccgcagccgtgaatcctaacacttgcagataacctttgggtaacatcaatgtatgctttccagccggaaaactatatgcatgcacatttgccaaaggcattccgttgatacggacagcattcgtcaacacgggttccgcctgaccgtaatcattggctgatgcatcaatttccagtttcggagcttttgcatactttttctggtcgtctttgaaataagcgactaacaatttcaccggagcatccgtttcgaaagtgatgcttgtgcctttctctctctgctcatttccattgaagcggagcgccttcattcctttcaattccggagctactgcttctatcttacctgggacatccacaaataaagaaataccctcatccactttcactgtcggataattagagatcagtttcacgtttgcaggagtccaggcagcaatctcgatagtttcagtcaccgcatttccattctgtttttctttcaacaaagcgaggttggctttgaaattttccaattccttctcatagtgtaccagcaattctttccaagtcttattctttccatcatctccaccaataggaatacgacgttgggcagtctgcatactgttggcatacaagtaatgttcgttcgtcagttccaccaatttgcgatagtgctccaggctttgttccatcaaaggaatagcttcttcaagattcttaatctcttttccccattgataatccaataccagtttggcagctttcactttcaggttgaacgcatacgcaaattcacgataacaatgcatatcattctgcaaacgtgcgaattcatccttatttgaagagacggaacctgctgctttattaatagccgctactgctttatctccatgttctattacttgagcaacaatatccaaaggcatttcacctatatgaggttgctttttccattctttttctacatactctatcagcttctctccttccggtccgcagctttcatagaatcccggatagatcgtatatttgtacggattgacaagctgactcataaacatacccagtaataacgtttggcgatttccctctgtgataccgaagcgacgtaacaacttcggagcgatctctccgctttcttcgtatgctacacggatattacttgcattttcgtcagaggttccgtagaatttgcccaactgatgatcccagtaacccatttcatctgtacggtcgcgatggcagttccacgcatagcgtccccaggtctggtaccagatccaatcacgatccaactggaattcacgttcattgttcggtagtttgtcagccgtataaggccagtcccaatatgaagcctgcggataaaggtgcaacgcattggcaccgtgtacattgtgcatggcagtgaccgccttttgtacgaaatccggagaaccccagcggaacggttccaaatttgccaggatatgtacgttactgatatgaatggaacccaacgaactcaaatccgtatgaattttcgaccagggaccacgaggttcgtaggtagtcaacgattcaccattatacttatgcatcgtataaagattcttatagagcggcaaggcagcgtccatcaccagtttgcagtccgtgtcgtgcgcacgcaacaaaagaggcggttcatccgtacgtcccaatgcctgtaatccgtctttcactcccggaataattgttttagtaaaccattccacatcgtcctccactgtacacatcgcttcacccagacaaacaagtaatcctacattgggatacttttcaatgaaagcggcaatactcttgcgtgtataatcggcaatcagaggagtaatggggcggttacggtcctgtgttttcagtccgtaatgttcagcaaaaggtttggaaagaatgatattataaaacatctgtatgacaaagataccgcgcttgtccgcttcttccgtgaggaaagagaacatttcttcattcattttgaaggtttcttcatctacttccagtgcaaacggataatcttccagtttcaccaatgacgcaaacggatggccattccaaaggtacagtgaattcatgcggttggcaaccagcatatccaagtatttaatccactgttctttatcataaaaccaggggaaactttccggcgtatacggatattcgtacacaccatgccccggaaggtaggtcatcttctgtaatcctacacatgcaccacgcaataccatttcaggaccgtctttcagttcctccgggaagttcaacttaccatccgaatcattcacacggtcgatcagttcacggcatccgtaaatgacaccactcccatccctgccggacactctggtcagattgcccgtcgtcgaaatataaaaaccttctttcttgagcgtcgtgtcatttacttccgtcaagagaatcgttttgatttcgggatcggagaatgtcgtgtctccctgttgcatcattacctgataaccggctttatccaaggtagtctgtaactgctccgcaccaaacaaaacacgatttgacgcatccggcggagtcataatcttcacggtttgcctgccacacgctgccaaaaaaagtgtgcatgccgcaaacatgaataatctggtatttttcattcttctgatatatattatagattatataattcacttcttcactaagagaaagacgaaataatcccctgtttgtactcattcgtctctttttccacttttcagcaccaaacttccactttcatcttgctgtaatatgcaaacgcctcattatttaaaagttatgcttatctttgccggctagtgtcttataatataaaacagaaaacaagagcaaacaatatgaaagaacaaacaaattatgactatgaaaaatacgttcagatagcacagatggccaaaatgggatggtgggagtcagatttgaagaataaagaatatatttgctctgactttattgttgacttactcggccttgaaagtaaccgcatcagtttcaccgaattccaccaaagaatacgtgaagaccaccggctgcgtcttaaaaatgaatatatgtctctttcttatctggagacatacgaacaaatgttcccaatccgggcaaaagacggggaaatatgggtgtactctaagattaatttccaaaagcccgatagagagggatataggaacatgacaggctttctgcaatatattgacagaccgatcgatactacgaatggaaacattgatttctttcaagtgagcaatttgctttaccaacaaactaatatttcatattcattgcttgcttttctgcaatgtgatgatgtcactcaagtggttaacaagacgttaggagatcttcttcaccaatttttgggcgatcgtatctatatcttcgaaataaacagaaaagaacaacgccaggattgcacttatgaggttaccgccgaaggaatatccaaggaacaggagttcttgagcaatattccctggaacccttctacctggtggaatcatcagatagctgaaagaagggctatcatactgaacacgctggacgatatgcccgaagaagctgcggaatatcgtcagacgttggagatgcaggatatcaagtcgctgatggtagttccgctaatctctaaagaagaggtatggggctatatgggaattgatatggtaagaacgcagcgtagctggagcaatgtggattatcaatgcttctcctcccttgctaatattatcagtatttgtatcgaattgcgaaagtcggagttacaagccaaagaagatcgtctagctttggacaacagcgagaagatattgagaaacatctataagaatcttccggcaggcgtcgaactttacgacaaagacggttatctggtagatattaatgataaagagcttgaaatattcggtttgtctgacaagaatgaggcattgggagttaatctgttcgataatcccaatattccttcagaggttaaagagagattgagagcgaaagaagatgtaaatttctccatcaattatgacttctccaaaataaatcaatatgtagatagccggagaaatgggattattaatcttaacactaaagttactgctctctatgattctcaaaatcgatttatcaactatctgtttatcaatatagatacgacggaaacgaccaatgcatacaccaagatacaggaatttgagaatctgtttcttctcatcggtgattacgccaaggtaggatttgctcatttcaatgtattgacaagagacggatatgcccaagatacatggtacaggaatttgggagagaaagaaggtattcccatgccacaggttatcggagtatatgcacatgtggttcctgaagatcaggctgttctgaaaaactttgtaggtgaagtgaaaacgggaaaggcaaccagtttgcgtaaagaagttcgtgtatgcagggagaatggcaaatatacatggaccagcattaacgtaatggtcagagattatcgtccgcaagacggcattattgagatgttgtgtatcaattatgacatcacgcctttgaaagaaactgaacagaaattgattattgcccgcgataaagcggaagaactggatcgtctgaaatcggctttcctggctaacatgagccatgagatccgtactcctctcaatgctattgtcggcttttccagtcttctggcagaaacggatagcagaagcgaacggcaggaatatatcaagattgtgcaagagaataatgaacttctcttacaactgatatcggacattctcgatctttcgaaaatcgaagcgggaacattcaattttgtatataccaacgtggatgtaaacgagacttgttctgaaattatcaaatcaatgggaatgaaagtaggtaaaggtgttgaactgattctggaggaaccatttccggaatgttatatctatacggataagaatagattcacccaagtaatcagtaactttataaataacgccttaaagttcacccagcaaggcagtatcactttaggatatgaacaagtatcccatcagaaaataaaattctatgtgcgcgacaccggaatgggaataccggaagaaaagcaaaagagcgtatttgaacgttttgtgaagctgaatacttttgttcagggtacagggctgggactttctatctgtaagagcattgtttcccaaatgggaggagaaattggcgtggaatcaactgaaggagtcggctcctgtttttggtttacacatccgtaccacgctgctgattagactgactatatatgaaagggggtattcaatgaatgatggttaatacttataataacgaataacttccaataaggaaaaagaattgtacctttgcattttattattatcatagttatgcaaaagtatatagaaacacctcgtctgattctccgcgactggaaagaagaagacatcccgttttttgcccgtatgaatgccgatccgaatgtgatggagttttttcttaattcattgtcatcggaagaatcatttgccttttatcagcgtattcaaaatgagttccaaacctgtggcttcggtttgtatgccgtagaacgaaaagaagatcatgcttttatgggctataccggactacatcagattacatttgatgttgactttgctccgggcatagaaataggctggcggttagcacacgaatattggggacagggttatgctcctgaagctgcaaatgcatgcttggagtatacgcgcaataaaacggatataaaagaactcttttcttttacttcccttctcaaccaacggtcagaacgtgtaatgcaaaaaataggaatggaacgagtgagggaattcgatcatccgcttgtccctggtgaacatccgttgtgcagacatgtgttgtatcacatcaaattttaaagagctattgactttcctctttttattttgtatatttgcaataaccaattagctgacaacagatatgatatatacaaaaataaagacataaagagaattttcagaaacataaatatgtgtctgaaagaatagaaatggggtggaatctttgcagattccaccccattttgtttaatatattcgtgtctacttagtgaattatcccgaatatcgttattataaatgtaagacccgtttataataaactgtttcattatttattaaaaatgcaaaatgaattcattagcatcctgtataataaaaagaaaacagtttaagagtaagaatagtacgaatacaatattcacaaatatatctatacatttgaggtgataaatgagctttacactaatattcttttcttctcattactcataacagcccaaactataaccatcattgtattactccatattatccgttttaggtcttaaaaagtataattgtagtcctaatgcaagcgcaacgacgatactgagcatagcaaatccttcgcccagacttccaccgtccgtccattttcccaataattgagttactgcagctcctgcaaaaactcctgtcatgttcataataccatatgccgtccctctatatttagcagaaacgaactggcatagaataggcatattgttggcatcgaaaataccaaaaccgatgccgaataacaatcctgcacctattacactaatgaaaccatgtccgaaacctagcaataacagtgcggggatggtcatccccagtccgattgcccctgtatagacacgtccgcggatattcttcagcacccatctatccgacaagaatcctcccaatattactccgacaaatgaagatagggcaatggtaatcgtagatattggccctgcctgtgacattggaatatccagattctccgcaaatagcgttggtaaccagttttttgtagcccaccccggtaaacttggagccgcaaaataaaataatatcacccaaaaagaaatatttgaaaataacagtaatagcccttttcctattgaattccccttgctaatgccattagcaacaaccttttctattttcattcggacaggattctcatgcaggaaaaagataagaaccacagaataagcaatacctacaatgccaaaccagtgaaaagtgctctgccaggaaaatgcagcggctgccgtagctccaaacccaccgattgcctgaccgacatacagtccggtcatgtgaactccaattgccaatgagcgtgatttgtcctgatgccaatccgctatcaaggacagagcggaaggaatatacaatgcttcactaatccccatcactgcacgcaaaccatataattgctcaaacgtcgtggcatatcccatcaggaatgttacagccgaccaaacaaacaagcttccgacgattaaccatttacgactaagcctgtctgcaataattccggcaaccgggctcataaagccgtaaatccaaagaaagactgccattaatgcaccgaaagcttctgccttcgtcagctctacaatatctattttcattgcttcctgcattgtagaaagcatttgtctatccatgtagttgagcaacgctactacccaaagcaacgcaaccactacccatggataaatatttttatttttcatggtagttgtatttaaaagatttttgagactgtttacttagacttttactttagctatcagtttgcgtatccagcctttaccgatagccggagcatgggggtcctccggatatacaatgacgaattgtccgggcaagagattgatgaaagtagtaggaacgtcaccatatagggcacaatcactctttttatcataagcttgcctttccacttttaattcttccaaggctttccaaccaatggtttctttgccttcaagcaatatgtgcacatcaatataatcgtgatgcagttctaataaacgctttccttcaggaatacattcaggatagatattattgacaatcagattatcaccatccagtctgatagttcccagttcctcgtgcaacagatcgtgcgacttcacataatcgaaaagctgtttgaacaacgggtgaagtttctccacccgttggctattttgtaaattggatacaatcatcttatttctttttttatttcagacattatttcctcacaaagcatatatccttttgtcatcatgcgagggatatgaaaaggtcctttaaacaaatttccttttgccggctgggcgaccgttccatcccgatgcagatagccataccactctccgtattctttgtccgggaaatgtgtatatgtccactcgctgatttgttgatgcatcttcaggtatttctcttctttcgtcatcagataggcatacagggtagcgataattgcttctgtttgcggccaccagaatttcatatcctgcgcatagtcctgcgaaggaagattcctgcaatctttgaaattgataataccgccggattctttgtcccagccccactcccatgaccagtctaaaattttcagccccagttcttttatgttttgatcccttccccggagcttggattcttccagtaaaaaccaagctgtttcgatacaatgccccggattgatggtacgtcccatattggagtctataaattctccgttcggtcctacggtttccaataatgccttgaactccggatgtaggaaatctttttccagacagctaatggactcgtcaatctgccgtgtcagacattcgtcttgaatagcttccctgattcgggaagctacatttatcaatatcatggtgatggaatgtcctttcatggggagcgtatctctatatttgggagcaagcagcccaggagtttgcaggaaatattgcatacgtttgaacagttcgagtgccttcaccgcatacgtcttatcccccgacgctatcgaatattcggacatcgctatggctgcaaatgactcggagaaaatgtaacggcgcttacgtaaagggcgaccgtccgctgtcacttcaaagtacatacgcccatccgaatcaaagcaatacttctctataaagtctagtgtgctttttgcggcttgcagccatgccgggttcttttctatatgattataggcataggaacaagtaaatgcaaaacgcccctgaaaccaaacggattttgtactatccattaatgcaccgtcgcgatctacacaagtatatataccaccattcactctatccagtccatactttatccaaaagggcatgatattattctgcatatcatccttataggtattagcccattgttgtatatagtcagtaatattcttcatacgtcctcctgttagaatttattgcaacgttcgaagaaccggatttcttccagttccgctttcatctgtttttcttcgtcatcggtcatgttttggaaaggagtacggttgccacccaaatccagcccgataagcttcatgatacgtttgccgccaacaatatttccacggaaatgacagattacgttaatcacttcctgggagaagttttgcaattcacgggctttctccaagttaccggctttccaggcatcaatgataccgaccaaatttataccgttataattggtcgttccgccgattccgccttgcgcccctcccattgcgaggcatggaagaatggtttcatcctgcccatgaagcatatcgaacttgccgtctttatacaaacgacattgattgtattcatacaggctttcgaaggtatatttgattcccgcaaaattgggaatacggttttcaacagctttcaggaaagcaagcatcgataagaatgctccattgaatgcaggaatgtgataataatagaagggcagcttcggtgctccggcagcaatctcttcgcagtactttaccaattcttctattcgtcctattttcgggaaaggaggtgccattgcaccaattccccaagctccgattttctgagcatgttccgccagcatccggcttgactttacgcagcaactccccacgtgtacaattaccttaaagccatccggtgcaacttccatccaacgttctgccaacttcattcgttcttcatcagtcaacatatacccttctccagaagaaccgttgatgaaaacacctttcaagccattttttacaagtagcttcgcataggcttcgattggttcataatttacttctccattttcataaaacggagtaaaaggagcattgattaatcctataatcttttccataatacagtttatttttttaagtttaatatatttagttatttttcaatttatccatgggggtatctataccctcgtctgatagtcccggtcctccaccgccggtatatccaccactttcgcctgtttgccatgccgaaatccaaaatgcatagatatccgcctgattcagataaaacttcaaccggactgttttccccaccagtgatgttacgcctggatgtttttcccatgaaatcatctgtttcgttttatccgattttttcattgatatgcagtctttctttgtaaatccttccattggctgaccgttatcatccaacacttctaccgctaaagttcccttcacatctgcatttacaaacaaatagtttccatttgccggaatctgagtttttatttctatatatccttcttttcttcctgcccgcatcgaaacaaaaccatcacgacgaagcatcgcaagtcctgtggcaaaattggaatcatgtttcggcttgctgttatagcgtccactgacataaaaataaagagagtctccgactatcagagggctacccgcagtagactgtacattgcctgcattccatgcatgaaagtcctcactgacaggaagaaatggtttcttgttttcccggttccaatgaaaaccgtctttgctccaacctatcaggacttcattccttttttgaatgttcagactgtcacaaacattgttctccggtccctgccaaacggtgaagtagcctaatatacagccctcatacggcattgcttcatgattgtatatctgtggacgcagttcgggaaattgaggatgacgcgggtcatcggcatcggcattaaaccaataacggataaacttatcactcttgttgtcatatatcctatgtgccaggctaaccagcatttccggatcttcatgttccaaataattgcgtgaacgcctatacactccatttatggttttcaatgacaggacatatttcttgcgaaacgggtcgtaataagccgcacaacggtcgtacaattctcccgaaagagctttcggctcactccaatggattccgtcagaagaatatttgagtttcatgctgactgtgaagcgattattaaattctacaacaaacattttataacgcttcgtccggtctttctcaaatttatcaagcaacacggaaacgcaatcatgctctaatgtatctacgatattggttcccggaacaacgtccagctccggttttatccagactttcccgtcggacgactctgcatagcaagtgacgagtcctaataactttccgccaccggcagaataccacatcttgaatttatgttcttcttcatcataccatacgccaccgctgaatggagcggcataagggtcgccatttatattcaattcccattttttatcagctttcaaaacaggattgccagaataatagatgggcgaatgatgtattcgttgcagatttgttttctcaatgaatgttgtatccacaaaaaggatacgtcctgtttgcccgcataccgaaacattgcacattaataataagaaaactgccaataaagaatatttcttcataatcgtcgacattttaaactacttacttttgcaaacctgtccgttgcggattctggcctttcatcggccatccagagttcgcataggaagtagctccagatgagatacataccatatcagatgcacctgcaacagcttcaatgccgacatataaatatcctcttgaatccattaccggactggaagtacatttaacgcctaactctgcggatgcaagtaaactaccgtcttgtttcactatataatagacggctttgttcgagatgatatggatatatcctctgttatcgatgattggtacgcagttgttaacgtcctccgttgtagcataatgccattttaaagaaccgtccgaattcaaagcgaaaacacctgccgaagcttcaccggcaacagcatttccaccgttggcataaagcgttccatccgtaccaatcacaacaccaccgttgacaatggctcccggagtcttgtacacccatttttccgttccgtcaggattcagagctatgatagcgccacctgatgtcagttcggctatggtataaatggttccatccgctcctatcgtataagaatttcctttcaatgctgtaccacccaaatctttctgatagacaaacttttgagtaccggtagcaaaatcataaccgaaatatcccgtattcttggaagagccgaaatagacagttccgtctttggacagagacataccggacaacacttctacatctaaagctatttctttgactacatcaccggcaggacttaatacgattattttctttcctctatgtccgaagtaaatattaccggatgcgtcaatagccggagtgacagcatataaattagaatcggcagctttgtatgcccattttctgctaccattatttcctacagcaaataaaaacaaagcacgggggtgttcagcagtagctggcttcaaatcacgaaccacaatatacacatctccattcgttcctactgccggacttgcatataccatgcttgccccaccgcccggattcagttcattcatattggcggttacgtcaaatgcccatttttgtgtcccattttccgtatcataagcataaagtttcacgtcaaatgctcctgtggaagtctggtcggtaatcatataaaccgttttaccatcagccgacaatgcaggtgagactgtactttcaataggtccgcccatttctttctgccacattacattgattgctttagccgggtctaagatggtaaggtccttcttagctgtggcgttcaaaccgttatcatcagtcaccgtcagtttaatggtaaatgtaccgtccgacggataaacgaaagttggattctgttccgtcgagacggatttttttgcatcgccaaactcccataaccatgctactatccggcttccttcatcgggtatggaagcatctttaaaaacagcggtctgtcccagttcgtacatattctcactaatggtgaagtctgcctttgccgcagtgtgataatataccttatcctcttcgcaagaagaaaatgcaagaatacaaatcaatgataataaataagctaatctgttcatagtattcattttttaattggttttatctattccggaaatattcaacccgggacctccgccagcggtatatcccatactctccccattcgcagaaggagaaatccaaaaagcaaatatttcaccgttatcaatatagaatttcactttcagttgtttgttcttcaaagaggctaatgaagcgttgcctgtccattctatcttcgcttttacattatcccctttaaaggctttgcactcatcttttgagaatccttcgattactttattattggaatctaaaagttccactttcatttctcccgtgacattggcattgacaaagaagtacgaaccgtcaaatttcaataagggcgtttgcagttcgcccgttcctttcatggaagcaaacccgtcgcgacgaagtgtagccagtccggtagtggtaatctcctgcgtacctctcaaacgacgaccgctcagatagaaatagagtttgtcaccgacaattaacggtgctccggctacggattgcaggttaccttgattccatgcgtccgaggtggtcgtatttacggcatggaaaggattcatatcttcacggaaccaactgtaaccgtcacggctatatcctaccatgacttgatttctcttgattacattgtccgaagcacaaacatcattttccggcccttgccaaacggagaagaatcccagcataatgctttcataaggcgtggcatcctgattatatatcgcaggtgctatattcggatagtctgtatggcgttgttcattagcccacggaccgaaccagaatgcactcaataatgcttccgctttctttgttccggcttccgggtcggcgttttcattataatccctcgcacgtaccagcttattcgcatctacccggacattatgccgcatgctatatacccaaacgtttctgaaaggatttttatataccgttgaacggtcggcaatcggttccgattgaactgcggcacgccagactttgccgtccggggaagtcttgtaatggtatctccatttcccggattcacgggcaactaaaaacatcttgtatcttttcgaagcattactttcctgtttatccagccaaacaacagacgcgtcacgttctgagttatagtcaacgatatttgttccggctacaacggaaagaatgggttttgtccagtgaataccgtccgttgattccgcataacaagtcactcctgctccgctagttgcataggagccaccacctgccatgtaccacattttgtattttccttccttttcgtcataccataccccgtcgctgaaaggagcggcaaatgccgcaccttttgtcccggttttctcccaatcctgttctggtgtcagtatcggattgcctgaataatattcaggataatagaacgtacgttttagattagtggattctatcaggaaattgtctacaaataactggcgtcctaccgaaatattaataacagaaggtttatccgacagataaaaaggtgacattcctttttccaattcagacgaagatgaacgtactggcggccactgttcgggcagacgaatgccattgtacaatagccgtgaatctaccggctcttcgtcaggcggaaccactaccgggggattattatctccatctggagtatcatcactgccaccgcaagctatcagcatacaaggaaggaaaaatagtaatgtataaaataaacgtttcatagtcatttatcttttatttgtttgcaggaacatctatgccacaggttgacagtcccggtccacctccgcttgtatatccacggctttcgcccgtttgccacggagaaatccaaaatgcatatatatcagcgttattcaggtagaacttcagtcggacagtcttcccgatgagcgatgctatatcctggtgtttcttccatgtaaccaacaattttgttttattcattttcttcatcggtacacagtctttccgcgtgaatccttctaatggctttccattttcatccagaatttctacggtcaagctaccttttacatctgcattgataaaaagatgtttgccgtcaaaacgaatcttctccgtcagcagatagccgtccttatctccatgcatggagacaaaaccatctctgcgtaaagtagccagtccggtagatgtatagctatcccacataatcttgtttctttgacgtccgctggaatagaaataaagtgaatctcctactaccaaaggcactccgttgatggactgcatatttccccagttccatgctccttccgtctcattcacagccatgaaaggcttgaaagaaggacgatagaaatggaagccgtcacggctataccctagaaagatttcattctttttctgaatacccagtttggcacaaactccattttccggtccctgccagacactgtacaatcctaacataatgctttcataagcaatggcatcaaaattgtaaatacccggttctacttccggaaactccggatgacgcggctctttatcgctcggagtaaaccagtagaccatattcttatcaggtactccttttcggatacgatgtgcgaaacttactgccatttccgggtctttattttccaaataactgcgtgagcgggaagaaactgttgtcccgtaacgcatactcaatgcccacacatcacgaaacggattgtagaatgctgatgaacgatcgtataaatcaccagactgggcgactccctctccccaatgaatcccgtctgacgagtattttaaaataaattgccacctgcgatccgtgggacggcgttcgacattgaacatcttgtaccgtttggacggatctttctcctgtttgtccaaccaaatagtagctgcgtcacgattgcaggtatctacaatattggtttggttccaaatatccagtacaggttttgtccagtgcttgccgtcttccgattcggcatatccggtataaaaggtctgattgtctcctttgtgaagaacgccggcacctgccaagtaccacattttgaacttccggtctttttcgtcataccagatcccatcactgaagggtgcagcgtagagtccgccttcggttgtcttttcccattccttgtcaggtccgagtaccggattcccttcgtaaaaccggggagtatgaatcactctattcaaattagtttctgcaatcagaaaagaatcaacaaatagttgccgtcctacatttacaggaattactcccggcttttgttcaagatagggtatcggcatatcttgtgctttttgtggctccgtatagcggggtggccattgttcaggcaagtgtatgccattgtaaagtacttctgtttgggcaatagcgagccccggtactaccaaactgaacagtagtaccgcaatatttttcaaatttatcatgctaattctttcttagttaatatcccggattattttctgtgatataagggttagaattcacttcattgataggaatcggcaaccattcgtgcttattggtgacgaatcctttaaagtcatctgccgatatgaacttcttgaagttaggatcggattcctgcaactctgtaaaacggctggctagcttgccccaacggagcaaatcatagaaacgatgcccttccaaagcaaattccaggattctttcattctgaatatcagccatggttacggaagggagttcgctcatgttggcacgtccgcgtactttatttaccgcctgcaagggagtcatatttgatgctggtgtgccaccgctgacaacggattctgcatacatcatcaacacatcggcatagcggatataccgccagttcaccccatgggcacggggttgattatatacatactccttgacgcccgcacctacaccgaccagtttaggagtcccgtctgcttccgtttgtgtaggcatggaacaatcaatcccttttctgatacctgctttgaatgaatgtgccaaaggattggacacggtagcaaatccttcttttccattctttgcaggataaagttcttcccatttataaccaccgggaccttccagacgtaccggattgccgcctgcatcatttctcaaatgaatgctcgcatccaaatcattgaatatcattgtggagaacattcggatatccgtataaccgtccttgtctaccgaattcacaaatgcgttataaagccagttatgtactacgccttcataacctactcccgctcccggcaacatcagtccacgtgaatcgaacgccaaaccggaagtggcaagccccggattgaatcctgcattatcgacatcgcctaagaattgaaattcaagaattgattcttcgttattttcatgagcgacatcaaaattatcggcataatttttagtcaggtcataagttccgtactttccgtctataacatcaccaaattctttggcagcttcactgtaaaatgtagtcttgtcttcaccataatattgctcgattccactacggtataggtaagcttttcccaataaggcggctgcagaagcttttgtcacacgaccggcattcttgctgtcccaatatcccttcacgggcaacaattctttcgcgtgtgccaggtcttcttgaataaaatcccatacggcagcaggtttttccaaaggacggacatagtcatcgccattgcgtggcatctgtctgatgggagatatattccggaaattaatcaataggtaataatgcgcaaatgccctccagaaataggcttcacccatgtatgcgttccgcagttcctcattgccgctgaaatcgacagacggggcggtttcgatgatgtaggatgcttgagaagcagtggtgtacatcaatgtataaggttgctcgatagtgtaataactggcattcaagtcggcaccaaacatgcccggtttgccataatccgaattggacgatgcctcgtcagagcggattatcgttgtcttagagccggaagctcccaggcagcgttgcgtagacatatatccgtacatggtcatcactgcgtcatttacagcggacggactggtgaaataagctcccatactcggctggttcggattaattgccagatcatcaaagataccgttgcatccgtgtaatattaagccgcccgccaagataaatgcggcatatactttcttatagtttttcatattaatcatatttttagttatcagaatgaagcgttaaaaccaaaagtgaatgtccgggcattaggatatgaactgatgtcaatgccacgtgagaacaatacatttgaactgacttccgggtcataaccggagtatttggtcaacgtaaacagattttgtacgcctgcataaacacgcagtttattaaaccggattgcttccaaccactttttaggtaacgaataaccaagctgaagattcttcagacgtaaataggaaccatcttcaatataaaattcactcggcagggagtttccgccactagtgttttgggttttcataatagggattcctgtatttctatttgttttcgtccatccattcatagcctctttgaccacattattggaataatcaaaataataggtgtactttttctgattgaatatatcatttccctgcactccctggaagaagagagtcaaatcaaagtctttgtattccatgttgatgttcaaaccgtatgtgaagtcagggatagggctgcccagaataactttatcatttgcattgactactccattcttgtccatatccgcaaatatgaaatttccttctgcatcaaaaccgtcaatcttatagccatagaatgaaccgatagcttctcccggcatggtaatagagggagcatcgttaaagtagctggacattgctccggaagtaatcggctgcacgttttctcccaatgataatactttattcttcaacgttgcgatattgaatgttgcatctatatggaagtctttcgtcaattgtttcctgtaattcatcataaactcccatcctgtgttttttacggaagctgtattgacgtatggtttttcacgtgaactgttgatttcaaagatttgtccggaagacaggttcaagtcaatctgtgccaacaaatctacgttcttcttcacgaaatagtctagtgacaaagtcaaatcgttattgaagaaacccagttcgataccaatatctgtggttttggcagtttcccatttcaaatctttcgatttcagataggctgcgcgtcctgtcacataacgttcaccgcctacagtgtaaggaataggcccataagctatcgcatcaaaattataaggattgaggaagttggcacccaactcaccgtagctagctctgatcttcaatttgctcattacaggattttggaaccatttttcctggtgcacattccatccggcggagacagaggggaagtaacctactctattgtctttatggaatttggaagattcatcccggcggatactcaaggatagcagatatttattatcataatcgtagttcacacgggcgaagaaagagagcaatgctgcattactgtcgcctgccgaaatcttaccatcttcattttggaatccggtaatatccgttcctcccaaatcgttaatggtagagttggtcatgtaacgatagtattctctcatccagcttgttcctaataaagcgtctattgagtgacggttgaatgtcttattgtaagtcagcaagttatcaatcgtataagtgaactcttcacctcttgtttccgatacactgttgcgtgtgttgccgtaatctttatcgggagttccatccgagttccactttgtatagtactcgggggtatgggtgtaattatgcttattgctataatttccacttaacgataatttgtattttaagccgccccaaatatccagttgggcgttcaaagagccgattaaatccgtcactttattaaactgatctgtataatgtaacggggctatcttattctgcgctttgccatcttcgggggtgatgtaataatcagggccaccagaggtaaaccgtccttgttcatcataaataggtaacgttggtaaagctatgttgaaagctgttgtaggagttttatccttatgcgtcagtccgagggtttcagaaaatgagaaacgtccttttttataagaggtattcaggcggaaattataacgtttataatccgaataaatcgtcataccggtttggtcaagataaccaaggcttgtgctgaaagtagagttatccccaccccctgcgatactggcattcagattccataccggagcaaactgtatccattcttttgaccaatcggtattcaggttcggattggtgggattgtcattctccggtgcatgaggcaagccactgttatctgccaccatattggcaaattctctccattccgacgcattgaggaactccggaatattagtcgttttctggaatgcgaacgaaccgtctatctggataacgggcttgccggactttcctttcttggtagtaatcaaaacgacaccattggcggcacgtgaaccatagatagcggctgccgcaccgtctttcagtacttcgatagattcaatatcattgggattcaatgagcttaatccggcattactgaatgctccatcaatgacatacagaggttcggtagcaccaaaagaagcggcaccacgaatcacgatatttacatctgcacctgcaacaccagcttgctgcacgatgtctacccccggcgtacgtccttgtaaggttgaagcaacattagatgatacctgtttgctgatttcttgggaagagatggaagcaacggcacctgtcagacttgatttcttctgcacgccgtaaccaactactacgacttcatccagtacttcggtgtcgtcctgcaattggatagaatatgagttcttattcccaacctttacttcctgtgttttataaccgatataactgacagccagaagagcgtctgccggagcatccaatgtaaagttaccatctacatctgtcacagtacccgtccccgctcctttcaccaatacactggcaccaattatcggttcgcctttgatatccgtcacggttcccgttattttctttgttttttggctcccttgtgatgctgcgggagcttcttttgctttcaaatatattttcttctctccaatttcataagctacatttgtacccgcgaataaatcatccaatactttagaaaggtctttgtcttttgcctggacagaaacaatccgttcgggattgacaattgtacggctatacgctaccgtaagtcctgtctgtttagtaatgagcgaaaagactttctccaacttgacttgttgaagattcattgttattttctgagccgacgccgcaagacttacagcaaagctcaataacaatacaagcaatactctgttcttcatacttagtttgtttaaagttataaataggttcttaatctctttgtatttagtggacacacgagattaagaagcgggtgagggaaaaaacgtttttttctgaagtttttttatttccaataatttttcgtatgataatatattagttttcagcaagatatggtttagtttttatttgtaggaaaatgggatataaaaagaaaagtccttccggattttattttcagaaggacttataacaatagattcgtgttcttggcaattcgctagaaacagtcttttgggataccgtcactatccggtccacatagtgacaccatacttaccggataccgtcactatcacgcaaggatagcgtcactatattttttgtaatttagtaaagttcctgattcaccaattcgtcaaagagctttacatatttctctgcgactgcttccgcaaacttctttcctttttccgcagaagctccacgcgggtcgccaacaccggtatctttagatactttcccccagttcctgggaatccatgctactttttcattcaaagattgtacggcaaaagttttatattctccattccctgcttcttcaagattgaccagttcggggtgatagtgcatcattacggacgtctcgacttcatctgcatggtcacccggattttcaaaatagtcctttacctttaacacggtgtaccattcactcgatgctatcaggaagtcaggatagtctaccgacaaatcacgaatcatacttttaaaagtattgccgccatgcccgttgataataatcaattttcggataccttgaacataaagggaagaaacaatatcggtcagtattgctttctgtgtttcataacgcgtatggatacagaagggaagttcccgttgtcccggattttgtgaacccatgccgataggcggcataaccatacagtttacgccatatttctgtttagccatcaatgcagcatcaactgctacatcatgggaaagaatacaatctgtcatatatggcaaatgcagattatgaggttcggtagctccccacggcaatatcacaatatcatatttcctgtcttttacttttccataacaagatacggataaatctacttctttattcatataccccatttatttctaatgattatattatttcatttttactatcacttctttcttatcttcattatattcaaacttcaccggagcgattttctctaaatccattaatactttctctaataatgtattgtccgaagtcaatgtatagacatacttcaaaacgttttcatcttcaactttaaactctacattataccagcggttcaatattttaatgacttccggcaacggggtatctttaaatactatcacattctgtttccacatcgacaggcgttgcatatcgttcattttggaaatagtacactgctggttatctttgttgtacactaatctttcgccgggttgcaccgggtatttcttttccgtaggaagggtaagattaatatttccttcatccagacatactactatatccttattctccgggtaatcctgtacattgaaagaagttcccaatacatgaattgccggtccacttaaattgactataaaaggacggttcttatttttggctactacgaaataggcttctccttcaagataaacttcccgggtgttcaaagcaaacttcttcgggtatcttagtttcgaatcagaattgatatatacttttgttccgtcctgaaacatgatttgtatgcgttcgcctttatccaccactacttcttcgtattcggaagtgccgaacaggtcgacttttgaattcagttgcatataaagtccgacaattaagacaacaggtatcaatacggctgcaactcggaaacagatacgcttcaacttcttgatacgaatgttcttccgtatctgttctaatattttctttgaaggaatatcatggtctacatacaagtctgcaaactcattttttatcagttcggaatcctgtgtcatagcagcttcaagatagtcgctaccctcttccgtggcaaaccactctgccacatattttgcatcttccgggctggcaattcctgccaggacttcttctatttgtttatcagtaggtctattcatttttatcactttattaaatggacactcagaaaggtcattagtgtggtgaatgcaacaattattaacatcttacttagatggatacggagaagtttcaacgcttccgaataatgcgtcttgatagtatttacggatagattcatccgttccgcaatttcctgatttgtcagttcctcttgtactttcatcaagcaaatatcccgtttttgcgcaggaagcatatccactgctttataaaaactggacatcaactcttttttctccagtttttctatcagattatcttcgtaaggcgaagcggcttgtgccatctcatagttctttgcaatcgcgctgttttcattacgaatcaagttcaagacatgattttttgtcatcgtaaagagatagttctttaggctgattcccacacgtagttctgaacgaaattcccacaaacggctaaagacatgttgcactacatcttctgccatatcagaactcattaaataacgataggctaatacatataatagtttatgatacctttcataggcttgggtgaaagctccttcatcaccttgttcaatcaaggcgaagagtttctcatcatctgtatcagtatattggtcaatcttgtttttcattcttcggattttgtttacttgtttccaaaagaactaaatgtttctctctttatgaaaagcaaatgtagcaaattccttagaaaacctagaggtatttacgaaaaaagtccccgattaacaattcctcttttgaaatgaggaaccgttaatcaaggactactccactaactaattaacaatgtattataaatgataggtaacaattctttcttcgggtgaatcgatccagaggcgccatactccttccgacactttctccggtgttccgatatttgctttaggtggacgacggcttttgatggtcagatagcctttcccttctgttgctttcactttcatcgttttgctgttcatatagacatggatattgccatttggagtggggacagtgccttccatccatttcaatcctcccaacacaggagcaatagcaaactctttatatccttcttttacaggtttcactcccagataatatttgcccaacaggtagataggactcgctccccaggcatggcacaaactctttccataaggacggccatacatggcaagatgttgcgttccggtttcttccgggttatatttttcccagaaggaggtagcaccttcctttaacattcctccccaataggctttcatttctttcattacagcatcctgttcgccaagagcacaaagtgcttccagttcgtaaaaacgcatatagggagttgttattttcagaatactgtcatttagcaaaacagactgtttgatggcttgttgcttatcttcattcaaatattgaaagaagacagaaaacatattcgcataacgggtgaccgcatcactttgctgaccgttgacgcagttatgtacaaatgcctgtttctcgttattccagaaggcaggttctaactttgctttcaaagcagcagccagtttctcgtatttctgtttgccattggcatctccaaccaattctgcacacaaagccatcgtttccagacttctgcaaaataagatttgttcaaaagagagttcacctttcttatccagatagccgtctgcccagtccacaaatacccagtcaccggtcataccttctaccatgccattcttattggtacgtcccaacacgtaatccatcattgtttgcatacgtggatacagttggttgacaaaatggcggtcgccactatacatataatagtcatatacgctaaggaaccagtagaaagtatagtccatgattgtattactgtggctggtcacagggtccttgccacgaagtaaccagattgtacgtttgacggattcgttatcaaagaaaagataataattcatcaaataactttggatggcatcgccactccatacccaacggtcacgtttgataccgtcaatgaagaattcgcgggtagtgagatgcatggtgtatgcaccaacttcccaaatacgattcagttcttcatcattgcaacgaaaatttccgcggtattcttcaggaagatattcatattgcatggagacttctccaatctgtacacccggctcgtgagttacatagacataacggaaggctttgctgttctccaatgtatattcgttttcagaattactcaaaggagaagtgctgcggatagcaaggtcggtcacttgtcccggttcgagcaagagtttgttcaatgtttcgcaatatgctttatcttttgcttcttccgggctttcaccataataaatttctatttttccttttccggaaagattcttcaatgtgataaatccgaatgtttcttttccaaaatcataaaggatacctccttcgggctgttctgtcttcgtaacaggttgctgcggttcacgcatcagactgaattgggaaggacgttgggtagctccgtcaaagttccagcatccggcatccatatagatagtggcagatgtgtcactcgcttttccgctctcgtcaatccattctttatcttcgtaagttacacgccaggaagagtctgaattcactgtttttcccttcacataaatagtgggaggagttgcctgattccagactttaatgttcagattatgttttccggccggaagcaacatggtttccggcataccgaactggagctttccatccagtttgacgttgtactttccttcggcagcaataaagatttcttccggctcggaaagattcagttgtttgctgaattctacgacaacataatgactgtccgttttccaaaaaggagggaaaaatgcacctcgttccgtacgacggttattcatttgatttcccagccagatttcgtagtctcccggataccatatccaggtctgggcaaatgtgctgcttgccaaagacaaggcactaagcaatatcatatatttctttttcatttttctttctattactaacaaactgaatcgtaagaaataattcgttccacagtggttgacgtttagttccacatctgtttccctttagttctacaattgttttcctttagttccatatctgtggaacgaatcacgtattacagttaaatgacttgtcaatacctactggatatttagtaaatccttatatcctgcttccagtcccgcacgttcacgaataacactatccaccttcgggccattgttttcccatacatttcccgggccattggcattttgcagatacttctctccttctgtccaattatcacgtacagtaataaaggaagaaccttcatccgtataaagatagaaccagtgattaggatcgtgtacataccccggcttataaatactatgcacgcaattctccgttacataacttttcggctgcgaaccgagtgtgtaaatacctgccacatcatacatgtgtttcgcataatgatgaatcagattggcatgtactctgttattacgcatacaattcacagtttgcgtccatccccaaccaagactgatgccactataaggcacttcgctgatttcattatgctcgatattgatatcctccacatatcccgcagcaatggcaaggcatccccaatcttcattgcctatttccgtgaaatagcaattattgatttgttgctgtgtgcatacttcccgacgatcagcagggtcgtatggcaaatgcgtttcatgggcagccggagaaaaactaccgactaacagaccatttccggcaatatcgtggaagagacagccacgaacaacaccgccttgcaccgcttcttcataatccaatccggttgagcctaaatgctcgaaccggcaacgttcgaaatcaatctgccttgcagcaaccacacgaacagcagctgcgggacgtcccaaccatccttggttatccaacggatgattcaagtagttccgttgcattttcggatcaatccggtaaccatctgtcagatacatacctgcctgaagaggtacatgtcctttttctgacggacgcatccatgtagtataggaaaaagtaattttctcaaaacgaatatgacgcacaggacgatccaaggttccttccacccgtactaatgtctcaacagcaggcacgatcacttccgcctcctgcatcttctctccttcccgtggataataatatactttacgggcatctatatcatgataccattctccgggtacatcctgcaattcgcgggcatttgtcagatagaaagcagaattatgtccgtccgtcgtcaccatcggacgcggccagggatgctcaaactgaatccggctttccggttgatgaaaacgtattgctgcgctgtctccctgcacttcaactgaacgaatccgaagattggcaacacaccacatctggtgtaataccatctcggcatatttagctttcaaattccctttattatcaataagtctgcgaatggaaactacaggtacataaagaatttcattcttctcatccacactgcaaatgcgattcatcttttcgaaatcttccacatcacgggcacgaactgccttttttccattcacccacaactggcggaaatccaatggacgtccattaaataccggtacatctgctacccaaactttcccttgcttcttccagccatttatgctgattcctccactcaatatcaccttttcatcgcctaccgaacgaatgattgtgggcgattctttggttccgctatcttccggacggataaaaaccggttcatggaaggcatacgttccaccttccatatagatcgtgattccaccttgaatacggttatcctctgtcctgcgccattctcgtgcttgtcgcaaggcagaagtcagcgtggctttaggagattgacgagttccgttgttgaagtcactgcccttgggagaaatccatatctcaccggccaatagccagtgactgcacaagatacatatagccgttaaaaataactttttcatgatttttttcatttctgtatactaaacaatccggattatctggcaagaggcatccatacagtcatttctccctttcctctgtttccccaggcataataaggaatcaagcggatatttactgtcttttcagcctgaacaactggccggtaaagcactccttcccacgaagttgcagatgccagacgtgccattccttcaagtgcaacaatcggactgccttcaattgtgattttcttcggagttagttttatatcagtgggaatcaatacgttatcaatcttttccccgtttgcaatatccatactttccagacagtaaaccaacggcccgcgcttcacgaccacctgattacgaatctcctctgctaacggatgagcttcgagcaaacggacaggcatatccatcaccagctccactacatcccccttcttccatgtacgatttacttccgcatacgaatttgcctttgcattggtttgcagcggctgtccattcactgtgagcgtagtcttttcgcaccattcaggaatacgtaagaagagcgagaaagcacctgctttacgaggaactctatccaacgttacacgtacctttccttcccagggataatccgtctcttgtgttaatgtcagttctcctttgtctttccaagtcgtagtcagcgtatttgcaccatacaagttacagtaaatgccttccggactcaatgtgtaggcgtaattctgtgcctgacacaatgtacgcaatgtattcggcgggcaacagaaacaactgatatattccgtccgttctttcggccaacgaagcgtgtaaggaagatcggcactgatacgaagcggattggtatagaaatatttctttccgtccagactgataccgctcaatacgctattataaagacaagtctctacaaggtcagcatatttcgcatcccctgtcacttccagcatacgccagttgaaaagcatatttccgatattggcacatgtttcattgtgcgctgtactattcggcaactgataaggacgtccgtagctctgatgtaccttctgaatactatccggctcatagcaagtcccgtccggtgatgttccatcataaagagcaccgcaagctccggtcacatacatcttccgggtgacaatatcattccagatactagtcagatttttcatcaactgttgttcacctgtctcagcatatacatccgctactcctgcatacagataatttgcacgtacggcatgacccattgcacgatattggtcgcggaaaggaatacgatcctgattatcatccgttccgttttccaccataccgcgaatatcaatcaggttcttcgaaagttccagataacggggatttcctgtggcacgatacatttcgaccactcccatataatgtgaagggcaaatggcattacgagccagttcggcagaagccgtttcgtaaaagtggcaaagaaaatccgttgcttttacggcagtatcaaaaagagtagtctttccggtggcacgacgatgcacaatacccgccatcatcaggtgtcccaggttatatgtctcaaagttcagccgattagcaaaagctcctttttcattctcgtcacctactttcgttccgatgaccgtttgtttatgctgatcccctaatgcatgagagtcaatacctttattcagttcttcgataacaacaggcgtatgtatataaccatctgcacgttgggcttttacgacacaagtaataaagttatccattaacttatccagttccggatctttgttgacagcatagacagaagccactccttccatccatttatacatatctccgtcatggaacggaggtccccaatgttcacccttacacacaccagcggcaatctcaaaattacggaaaccgtgagagatctccggcgtgttccaagtgttccacatactttgcagggaagtccggctaaatacctgaaagcgatctccccagaatccatctgtccaatgtacggcactgattccggtattcgccatcttcgcaaaacggctctgactcatatccgtcaatccattgctttgcgcaagtgctcccgtaacggaggcggaagctaaaagaagtaacagttttatctgtttcattaatatggataatttaaaatttacacaatatctttataaaaagacgtgattatccgtattttgtactcaataaaacgaaagcgaagattgctaagcaaccctcgctttcagtaaaaaagatctgtattaatctttatttcttatttatcaggtgtataattcaactccgcctttctcgcctgcgaatgttgaaattgtcgtgcaaccttatactcatgtccgtcttttaataaataactccctgtctgcttaaaccaaaaaccgacattcgcatctatacattgctgccggatatccaatacccactcgtaatcacatactcggacttctttgcctgactctcctcctgccactacctgttccacccactctcccagctcacctctgaaatcaatccgactaagaagcggctcgcagataatgattttatgtttaatagggatttctttataaataggtaaacgataatccactctatcttggttctccatcgtgcagcagatggtcacattgtcatagccatctccccaatcgggaggcagacactgttgcaaccggtctatccgcttagtgataaagaggaaacgaagatcctgccgtatccgcatcatctcccacgcttcggcacgccattcatccgcatcttcaatgagaaaatctgaagtaaaacaggtatataccaaatttcccgaaggtatcttatacataccattctttttacgctgcaagggcaaatcgaacttttctgtctttgtcaccaccgaactgtcttttccatatttaccatccgtccggtatacatagcaatgtcggcagccttcacttaatttgtgacagccgtgccatagattccacattgaagctttttcacccatctttttttttcttcaaaaatatatttaatattacatatacataactataaaaagagtgcaccttattctttatcagaaaaaaggtgcaccaaaacacaaacaaaacaaacaatagagcgaccttcacaggcagccgatccacgagggatctttatcttaatctgcccatcttgacaagggcaacattcacattttcagatcatgtaattcagagcatcacagcagaaattttcgccctcatgctgcttatatgtcagacacaaatattattatacaatttgctctattaaacccgatgtcactttacaaagataacactattctatgtatttctatgaaaatgcccaaaaagaattattctttttctcattccaaactttagctataagccataacatacaagctgaatgtctaatatccatcatttcacatatcgctccagcccttcctgcaggaactctatatattttggaatatcttcattgtatgcataagatttattcaacggattaccgtcattatccagcaatacataaaaaggttgggcatttgctccaaacttcacccgttgcagatagctccatttatcgcctactgttcgtaaagtgcgttccgttccattctctacaacatttataggctcattcaatggagttttatcatccacatacaaagagataagtacatacttatcattgatgataccacccactttactatctgtccacacagccgcctccatcttacgacaattcacacaaccatatccggtaaaatcgatcatcacaggcattccttgttgtcgtgcatactccatacctatttcataatccttgaatttggggtggacctcattcgaatataaattaaagtcttgtgtcatcacaggaggagcaaatgcactaacagctttcaaaggtgccccccaaagtccgggaatcatatatacagcaaatgctaaagaaacaagcgcaagaaagaagcgccccacgcctaccctgttttcatcaccgtcatgcggaaacttgatctttcccaatagatataaccccatcagtccgaaaatcacaatccataacgcaaggaaagtttccctatccaggattctccagccataggctaagtccgcaaccgacaaaaatttcaaagcaaaagccagttccagaaaacccaatgtcactttaattacattcatccaccctcctgacttaggcattgatttcagccacgaaggaaaaagagcaaacagtgtgaatggtaaagccaaagcgatggcaaaacctaacattccgatagcaggagcaatcacgctacctgtcgtagaaacctgtacgagcagaaagccgataatcggccctgtgcaagagaaagacactagagataacgtaaatgccatcagaaaaatgcttaataggccactcgtcgcttccgctttgctgtccactgcattgctccatttagaaggtaaagtaagttcaaatgccccaaagaaagaagctgcaaaaacaaccaacatcaggaagaaaaggatgttgaatacggcgtttgttgataaagcgttcaatgcactggcaccaaatattaaagtaattgctaatcccagtgttacataaatcacgacaattgaagcaccataagtccatgcatcccgaatccctttcttcttatccttgtttcttttcaggaaaaaactcacagtcataggaataatcggccatacgcagggagtgaacaaagccaataatccgccaagaaatccagtgacaaagacatacaaccaagatttatcctcttgagaatgttcttcacctaacacctgcaattcattgattaccggtttccaaagatcactttccgattgcttctctaccacatttaccggagcctcttctttcccttttgcaactattaaatctgcttctgcttttttcccatatttaaaaggaatttgagtcggaggtaaacagctctcatcgttacaagctccaaactccagaaacccatccataaagtaatcatttcctgtaaatttcactttttggataaactgtaccgtatcttcaaaatagcgcacattcatctcgaacatcttatcatagatgctgatttcttttccaataggttgcaatttacccattgtttctacatgattactcgcattgatgttaaaagtagcggaaataggcccatcatcccctagcccggtcgaatacacatgccatcctttctctatcgaagcagtaaacacgatttccgcttccgtttcagatgtcattttcaactcatttttgaactttacaggctctttgatttgtgcttgtatattcccgattgtgtaccaacctactaataaaaataaaataattctcattttctaagttctaaattataatctattatacaacaaatttatttcactgttcatattctattgtggtcgttggtcccttatatctttcagcatctctatatattctggagaaggattcttattagaagtatctgcatttgatggcgggggtatcactttgatgaataagaagatacagaatattacccaaataagatttattgctaaaaaaatccaaacttgtttcatacgttgtcgttgtttttctttagtttcattacgatatttatcagcaatagacaaatatcgtccatcgctaacaaataatctatgagcagcaaaagtgaatataacagccaaaagtatacctaactcttcattgttttgtacttccaatgaatgtaatactccaactattgggccaacaaaaacaaaagtaaacaatgaggtcggtagtaataaccctgctacttctggcgaccgcttttctccccacaatctaagctgccatatatatgttcgataaaacagatattcatatatctcatatatttgtttaagtatattcattctcaatacatttatgaagcaaaatggggatgctctcactaacaccttatcgagaagcatcccctttaacttaagagaaaatttatttcacaagagatttagtcttactaatataagttttctacttccggcttgttgtaaatgagcgagccaaaagttcctattgagcgtttcacagacacagacggtaatctttgaatttcatccatttgtggacgttccattttcatctttccactgcgaactttagctttgcctgtattgggatccactccttgaatatcacacaaagcataccataatggtaaattgaaatcgaagttatcccaatctccaaaagcatacggaaacgcattatcaatatcatccgtatagtctgcattttgattattcagcattacatctggctcaattccatcggcataatccccccaatcctttgcattgaacgaacggaaagtaatcggagcaaattcgtaataagagttaccatatttatactcttgcacctccataccaacattttttccttcagtacgactaccaaatagttttacagggaaatcaattcctcttaatccactaattaccaattcactggaagaagctgtctcttccgagcagataatccgtatggaattcaaacctaaatcatctccatcaccaaaccgaatatactcatctgcaccagaactacgttgcatcctcatgaaaacatcagaacgatgtgaagaacctgcaatagaagctgataaatagcgtgacaattcaaccgcacctccgtaattataacgtaaatccaagattaaatcggtaataccttccgttttgaactgctgtatcatatattttaactcttccgcataattcaaatcaaaaccttgataaacaaggtaagccacattcaaattaccttctttttcttttataaacatagaataaagtaccggattgttattataagtacctgtcgtcaaaataacacttccatctaccaattcatatttttgcaaatcttcattaggcacatagcgtctatatccaatattgaatgattctcctccacttgcataatataatgcattcatgtattgctggtagttgtttttattcaaagttaccccattcacagcaacaattacatcaccgcgtcttaatccagcttttgctgcaggagaatcaacaaatacatatccaatagacaaaccgattgtcgttctatctgccatataggaagagaaaaatgttcctaatcctgttcctaccatgcttgtagcacgagttgtggcacgagtatcgctagaacccactttttcaatatatgaataaatataacgttgaccggcattcacagaatatgcacgggaaattcctccatcttctgtatttgttttcatcttcagaaggtaggtagataaaaagttatcatacgaaacatttttgcaatcaacttccagtgtattatactcatccttgaatagataatgttccttcaaatagttatgcataaattcgtttaaagcaatatccgcagaagatacgtcaccagatcctgattgtgttatagtacatacaacttcaggtgttttatatccctcaacttgcacaagtactgtcagtattcgttcctgtccggcttcatttttatcaacttttaccctaaatcctcctttaccggcagcagaattaccactggtattagtaatagccgcccagtccgatcctgtagagtattgtaaagaaggagtccattttccagaagcagtaaacgagatctcaacagtctccccataaagtgaaacagtcttttccatttcactgctaattgcagtgattccattatccgtaccgccaacttctcctccgtcatcactatccgaacaattactgaaagcaatcagacacaaagcaagcaatactacactataaaagctattaaataagtttttcatctattattttattaaattagaaattaaaattattgcgtcggagcatctactacagttttagaaacctcgtaaaaacgtccttcttcatctatccaggtaacattgatattagttggcaatgttccataagtacttcccgaataagttgttgtttgttttacaccattttgcatcacatacctgatttgttcatcatacataccagtcaggtaatctgctggccctgcaaatacataaaagactttgcaggcagacttcggtttcacagtataagaaacggtgtagaatttgtctttttctatcttgtcaattgttacttccggaacactggcattccacaaatcggcgtccctttcttttcgcacataagtcggctttgcacttgtatattccttctttgtcacagtcgaagaaggattaccatcagcatcaactgctatcatgaacagtacatattctgaattaaatgcaatatcctcaatcaccagttgatgattcttcagttcagcagcaacaatttcagtaacattaccattcataattaatgcttgctttactgtttcttcatttccccaatacggatagcttttgaaatcactcaatttcatgtggacataacggaatttcaccggatttccggtcggggtcagtgttagtgttgtagacacggttcctgcctctattgccacatccaccgaaatagaagaattataggatatttccttggaatcagcttgcactttgactaatgacccgagttgtcctttctcattcaatgctactgcaaccaaaaagccttttgttcccggttctaaagaagctctttcaaagttttttgcctctttggaagaatctccgtttgtaataagataggaaataacctctttgtcagtgctataatttgccaaagtctgttctttcatataagaataatagaacttataacagtcagttcccggagtaatggtcgcactaacacttgaaactgtagcaacaatattaccgatatttatggttgccgttccgtcatacgttaacgcaggaacgggaatctccaccgctactagttcttctgttttataccccttttcttctttataagggatagcccaaagtacgtatgttgttcctggtattactttcggaagaaaatccaacacttttccctccaatggcccattataatccgaatactgtttagttccgccaccataagccaaatcgtcaataaccccttctggtgaataattggacttatctacaatccctgtgtaaaaaacgtcacagccctttctaattgcagaaaccgttgcaccttcaaaagtaatatccgaaaccttcagttctacagttgcagcagtcttaatcacgctggcaatcacatcatcaggcaaatatgcactaccagcctcagatgaaggtactgcccaaatcatatacgtctttccagcttcgggatccttacctatcagttcagccaacggcattttatcaagagcctctgtcttcatatacatacgggcagtatatccgtttactaattctgctacagcctctgcactatattcattgatttccaatactcccaaataatacatttctatgccattcatcaaagtagtagaaactgtctgccccacagtagatataactataggagcatcccctatgattacgggaatctctgcgataatactctgtccgttggatgcaacagccattatagctactttgccactcgtctctgcatactgattttctgccacaggagcagtaatagtcagcccttttcctgtcagggaagcttgccaaccatcaggttttgttacggtatacttcgaaattccactcatttcaactgaaatcaatttctcctcaccgttcgtaaagtattgctttccggacaatatatcacatttcagttccttagatttcgacaactttaatattgtgccatctttcagagtaaaatacgcataatcatcatcctgactaactccactaaaaagagaggtatctcccgttccttctccggacgcgtaaacaccggtaagttcccaagtcttgccaccgtccgtagaaatctcccactctttcgtattcgtattaatgcgaattttaggagcggcagccgttacaggcatcatttttccttctccatctttcaagaatgtctttttaccgtctgtactagttattccccaataatagataccatcctcttcgttctttatcacggttatttgcggagcatcctccccattttcaccattacgaatagttacttctgtcttatctgaaaacttaattgtataacttccgtcttcattctccaatacagaagcgattgatttattttgagataaagcatctgtcagtgtcttcaatgtggaaatatccgtctgtacactttgtaacgaagcttccaacttatccatgcggtcttccagaccggaaattgagttttttaaatcatcgtcattataacatgacgacaacattaccacacatactgccaggaaacatacatatttccccatactacataaaaaatattttcttctcatatccatgataatttagatgattagagaaaaccgcacgacagactttcacgctatcgtgcggaataattgcgccaatactatttatttggcgtgaggatgtttacccagttttttcaaatcaagataaatagtacttccgctcatcatcgcaccaggagcactcttatctactttctccttaataatcgtatttgcaggaatctgtctatctttctttataacttgtggttttgttgttcctatcataccctttactgatttcggagcatccgggaacaatacagaaggatcagtaatgatacctttatctttatcatagaatacagtataaagatcaccaataacttcattgccatcactatctgccccaattggtacacataaagcaactaaacgtttggcttcacttgtcttatcgtatgattgagtcgttgaatttactgttgtcaagccataatccaaacaatgttccttccatacatccatacactcctgataggtataatcaccacttgcagaatacgtatcttcaagaattgtatgataaactttagccacatcctttataatggaaaactggacagtgaaattattcatttcactcatatatgcacgtaattccatagttggattcggacctgccacaattgcttcagtagtagcttttacaatcttcacatccgtcaacacaccattccagtcttcagccatatatgcgaacgtatattcagtagccgggtccaatcctgtccaagtaaagctttccactcctcctgttgcatcagcaggccatacattagagtcttcagacagtaaataattgattaattccgctttattagcatcttccagtaaatccggtgtcataatatactgatgatagaatacagccgttttctgattataagaataattcagtttcagacttgtacgtcccggatcagtgatcgttatatcaatatcagcttcagatgcatccggagtatcagtaatacgcgctttggtagaaaatgaagcatgctttacttctttggataactgcccatactcattacgcccaatgtaagccacgacataaggagcatcaggaagcaaatcaaattggaattctgtacctttataggaacctttttgagcgaaattcgtatttttcacaccccatccctcctggtctaaagttcgtgccaaagtggtcatggttgcttcatctgcattttcataaggagcccagtcagaagctttaaatatacgataaaacatggcaacgcaattgtctttcatttccacattcaaatcaaccatggaagcaccaatcctactaatttgtagattacattccggcaattctgcattcgggtctatttctttcaaatgaaagtcctgacggacatattcacccggagtcttgttctcatccagcccgatgctggtagcggttatcattcttttcgcatctgctgtataaccaaaatccaccgtataatacaattcctcttgaggaacctgtgcatcttccgctttttgaatccagtgtctcataaagtctatatacatcgactttccatacgtatttataaatgcatcaataggttctgaatctccacagaactgatagaaatacttactgtccgtattggggagatattgtataccaactgcatgataacttgtagtaacatcaatatccacacgaggagtgcctatcacactctgaaccggcgtcttcaaataacaaattttcatgtctgcaggcgtctgtccgccctcatcattgcagcctaccgttataatcaaatattccgctcccggcactatttctgattgggaatatttagaatttacccagtcaaattcagtattcgggtaactgtctcccaatgtttgcctattgaatgtataagcacccgccccctcagaattatagatagcctccattatcaaatcttccacctcttcctctgttgcttgtactcctgtccctacactttcgaataagtaattgtacatacgacataaaggatatacatccaaccgataagattggactttagaacccggagtacactcaaatacaaaattatgttcagtgttactggtaacttttatacctactccacgttcgccaccgtccacttcattctcaacccatcttattggtgtcggatttggaggaagcggaacatccggattcactggtacatcaggttctacacccggttcatcactatccgaacacgaaaggaccataggacttatcacaaagataaatcccaacatgagtaataaactaaataaattcttcttcataattaaaagtgataaatgtgattaatcatttacatattcataatcggcatcgccatcaatagccttgcagacagccaaattatttacatatccgttttcatcggtaaccaatgcataaaaagaaagattctccgcattccatccttcttccattataacagtataacttatgcttttctctttaccggctgctatatgtcccaatttatcgccatcaacggtagcagacagtaatttacgtaccacatggttatgtgtgtaatcacgataaactcccccgtcattttgttgatatttcaatccgttttctaccgcatataaaatcaaacgatattcagcgcctttttccgatttaacgcttaccgtcacatcagcctgtccgttatattgtgactggatggccactccgcaagacgcgggatactcttccaaagacttattaaatacagctcgcatgacactataattttcagacaatcccattgcctcacgcatatcgaccacacatgaaggataaccggagatagcaaactttctggaaaggatcgaagactgttcgattgtcatcggatcggcacttgtcccatcgacatggaatgacatcagataaacaattccctcataactcgaacttatcagatagttcaggcgtgtcattcctgccggacacatagcacaccaagttccggtaaactccattgcacaaatgcgtcttacaaacttagaaggtgtacccggtgcggcactcgcaacaaccgttaccaatttggatacatagttgccataagatgcctcaaaagcgtaggttccggctttagaagtagaaaaggtatttccatccaaagtttgtccgtccatcacggaacggatgattgcatcagcagttacatctattcccgcatgcattaccgtaaaggttataatatcctttccgtccgcagtcaacgtatttttatcgacactcaaaatcacttccgtctgctccgaatcatcggaattgcctgaacaagaaatccagcatattcccacacagcacatacagaccagcaatattattttatagacatttatacacataactcttctttattcgttatacaagtaatctgctgattctccaagtttacactcatttacattgttacacgtataagtctttcctccatccaaagttgtcagcatcgacactatcacacgcatattatccacattccatcccggttccaactgataagatcgttgcatggtagattccactcccgcatttacttccccattaaaacggtcgccgttcaatgatgtggacaccactgcgcgcaccacattattatgcgtataatcattcgcgccattcgtttgaaagtatttgattccatcctctaccagataaatcaaacaacgataagtgtttgttacgttggaagttaatttgccagtaatcttcactgtacggtcagaagcattatacacagactcaacagctaccccacaagaagccggatagttacttaattctttctgaagctcttcttcaatctggctcttgatactgatcatttctttagtacccttacgcagattgtaaaagaaacggggcagtcccgagaaattaccgagaatattagtccggtaattattggtagctgctgtactcatgggatccgtcattcctccgaaatccatgtggaaagaagcgatagccaatcgccccggttgttcagtctgaattgctttcaatgtagtgctaagcgccggacaggcctggcacccgacagaagtaaactgcatccccagtaatttatgataatagctggttcctcctgatacgggagcaacctgaacggtcacttcattttcactgaccattgcttttccttcataatagcgggctttaaagacatacgtacccggcactgaagtgctgaaagcacgaacaccataatccaggttttcctctcccgattcctttaccaaaatcaggttcattgtgctttcttcacttacatcttttgtacccagtttgaccgtgaaggtcactttttctactccatctgcctgtatagccgtcttatcagctgtaatacgcaaaatgccgtcatccgtccctccattctccgtttcgtccgaattgccggaacaggatgacagcattgctaaacaaaggatcattacaattggtagaattgtcgagtatatttttttcataagcctcaatcattatagagatagtctatgctaccattgatagaacattcggttatattatccaccatatatgcgtcatccactttacgcaatgcataaaccactacacgcgatgtggcaggattcaggttctttgcattagaaatgctgaaagttgcggcagtgtgctcctcgtttgccttcacagtaaaccgtccgtcggttgacatcgacaggtaattgttggaaatagctcttactgtataatcgtacgaggtctcatttcctccggatgccgtcaaaccatcagtcaccaagacataaacaaggtcatattctcctcccaagctcgacttcagtgcggcatccaccgtaatctcacccatagaagaattataagatgtatttaccttaattccgcaggttgccggatattgtcggatttgactttgtaaagtctgtttgatagcactcacgttcctgtctatcgacatgactttcaaatcatagatacaggtaggaaaaccggacgctccaaaacggcccatgattgtgcttgtctgtgacaaatggaacgggtcagtggcggaactgctggaagaatgaaaagccatttttaccatacgtcccggcatcagttcttccactttctttaatgccgaagtcatggctggacaataggtacaccaagttcccgtcattttgaagacacctactttacgatagaaaagttcataattcttacgattctgtgcggttacggaaacttcatccgactcccagtccaggtaatatgccttaaacttatgtgtcccgttctctactgccgagaacgtattggtccgtctctccaaataatcaccggtagttacatcttcaaaatatacattcttcatatattcggaagtcgtcagtacttttccattggcatcagtcaccgtaaaagtcgccatatctgttccattggcttcaatcttggctttatccacagtcaaagtaataggtcctgtcacttcgccgttatccggctcttcaccattgtcgtcagaattgccgctgcacgctgtaaaacatccgcacaagcatatcagacttgacataaaaaacattgtaaattttctcatattctatattctaattaataaatgtttcgatgaactcaaaatgaagtagttatagtcaggttagcacctgtatatttaggaatcgtccggcaaactccaccagagcagacgtacccttccttgttacgaccataactcaaggctatacgcgtacgtgatttggcataactggctcccacattgtaataatggattttatccttgccgtgattatacatatcacttccgtaaatgctccatgccggagcaaaatttatctccaacagagctgccatccagtccttctgatcttcttttgtagttagatattgcaactccatgcgagttgaaaaagaaggcgtgaacttatattgtaaatctgctacaaaaatattcgacagattagtcgttttattcgctccgtacgaagggctatattcttgcatggaataaagcaagttcattttgaatgactttgtccattgcttttccacatcaacactaaagtcacgaaatgccaagttacctatctgggctgttccttctttttctaaagcataataggtagaaaagttagcatgtaatttcaaaccgcgtttacctccaatgactgttcctcttttgaaatgataaaagatatccaattgtccgcccatctcaccgctaactgcatttgtcacatctcctatttgtggagtatgaggatgcaagttggtcaacatataggtatattgcgtactcatagccgggacataattcaacagattcgaagtcgaaccattaccggcaataatctcactattcatccattccaaacggcgcccagtcagatttacccccaacccattgccgctatatcccagctccagcaattgcgcattggcacgtttccttgcataaagtttgtcatcatggatgaaattataatatttattgccaccgtccacatattcacctttcgctgtaaatccggagcgttcaaaatttacccgtcccgagaagccattcgaataaggttttcccccttcttcttcgaggtcgatattgattttctcataccggttcaatgcccctccttcgatactcaaggatgtattttgccaaccaagcatttcagataaggagaaacttacatctacgccacgtacttgtgtatcggaaaagtccataccaaaacgtggagttccccaaatggccttcaaccttacaatattcttgtaattgtaggtaaaacgtgctcccatcaccgcattattcaaaccaagcatacggtcctcccaactacggaatagcagtccactcccaaactgctcataaaatgtacccgctgttacggaaaaatccttgtcggcccaagatacgtaatagttggttagttttgctttctccaattctgtcgggtatcccaccagtaccggttcataggcttccaactgtacacctacggcaaacttaccttgatagtaatccagtttcagataattgttcgaaccgaaatgatcttccggagattctgcttttgtcttactatcatccttgtagtaaatcgtattcgtttcaaagctccctgtcagataaccttttttgttatcttgctgcgcataggttagagtagacgctaacgctactaaagccaacacctgaattcttattctagtcatgtcattgcgtttatctatgaataataacagtttctatttctgtagtttttttatcgctttcagtagttccagctcacttcccggcgcatacccggtgtgtgaatagacaatcttcccatctgcatccactacatatacctgtggagtcaggctcacattcatagctcgcatgaattcctgatttttatcatacaacatgataaaatcatcccatccatgtccctctgccaatgcacgcgctttagcagtagaacggctgtcatctgtcgaaacagctacaacacggaatttggcttcttccaaccaatcgggcaattgttcatttatagcgtccaattcacgaatacaaggtttacaggttgttgcccaaaaagaaataatcataggtgttttgtgattaaccagggaggaggtatttacctgtgctcctttcgcattttcaaccttgactgatggtatttgtgccatggtacaagttagaaaagcgaacaacaacgtaatgcagacaattaatgctctcataagttcttttatttgttatgttaataatcttgttttatctgatgtgttccatcttacagccaaatagcctgaatttctgtatttgtatcaagccgtccttatacatatcgcctatcaaattggcattctcgaaagtgacagttttagtttcaacatcatattctccgcgatatacgtcagaagtacttccgtccaaagccagtctcctgaaacgaatagtatacgggccataagaagcgacatcttcacccggcacaatggacaggtaggttttctgcgcctccgaatcatattcataatgcaaccgccaactaaattcccattcaatatcattatccggatcaaatccattcttattcgagcagaccagatagtgttcgtatgcctccgtgccttcttccgctgtatttactctaacggagaatcccactggcacattggaaacattggtggcagaggccgttccggtaaatacccaagttcctgaaagcgtttcataaaaactggaatcattgtctttgatagtcaccgtcagtcgcttgttctcaccaatagacgcccctttcacatcggcaatttcaacatcaaaagaacggtcgtcattaacaagcttgtcatcaacggtcttaaactcaaaattcattgtttcctgcccggcaggaataagtaacgttttggttgtgacaatatagttttcatcctctttggcattatgatcttttaattcgaacgtcacacggatagttccggtatgttcgcccgtcacaacaacaggcacagtacacaaaccggcagattctttcaccgtcattgcagtttcctgcaagtttaccgtagccgctccggaattaaactgttcctcatcgtccgaacaggcggcgatcagaacggcacatagaagaagggtgtatattttcagatagttcattttactcaagtgtttgataatttacgttattcattgattaatatcccggattttgctgacctgccaattgagggttggcatccatttctgttttaggaataggccaaagcatccgctggtcatccataggtttatccagtccgtcagtacttgcttgtcccgggaaaagcaccagtcctttgctttgcggttttccacgcttcacacctttcccccaacgtttcaggtccatcaaccggtatccttcacctacaagctcacgttcccgttcgttcatgatttcatttaataaagcttcttgatcgtaggttgcatcagtccatcccttgattcgcgctttttttaatgcattcaaagcgtcattaccctttttcactgcagctgccgttccaatctttgcattagcttcagtggcaatcagatacatttcagcaattcggaatggtttcggctgattcaaatagcgtgtttcgcttcctaatgcattgtaatattcattgcccggatatttattaaagaaatagatgtctgccgcattacctgacgatacggttaagtgatattttccgaaataagtctttagccggatatctttttcattgtataagtcaatcagtgtttgtgtaggaatataatccttctttgtagtcggataaccgataaaaatagtccccagaggtacaccggcatcgtcggcactagtcatggcaatctgccagatggtttccgttcccttgtcattcttccatacactttcaaaatctgttgctgtgttcgataatggatatctgttcgaattaaccaggtcacctgcatatttggctgcattttcatagtcgtccatttgcagggcaacacgcgctttcaaggcagtcactacatctaccgtgatataattcccacaattcttgggagccgtgttgactgtcacgtatgcaccattaatatacctgtcataatcagcaatgccattttttgcagtctctatacgttcttcggcttcttcgaggtcctccaatatctgtttgtaagtatcttccaatgaagatcgtcccggatattgggtagcagaaagtttaggctcatattttacctgaagcggcagtcccggagtacttgctgcggtagctacatcgtaatcgcggcaaaataaagtagctagataaaagtagcagtatgctcttgtaaaatacgcttccccctcatacacattgatctgttgtctctgggtttcagtcaattcgatttccggattctcatcgatcttaccgaccccgtcaataaagaagttgacacgtccgatagcggcatagtagttcgaccagattgtttctacggtagagttggtgctctcgaaagtccaacggtgcaactcaccatatttattagagaaatccgccactgcattaaaggcatctgcctgaacttccggagctaatacatagcttcctcctgtcagtcctaaatatacggaatagataccggcacgtgcttcttcaaaaccgactatggtcgttaacgcttcttctgtaggaacagcatcgtatggcattttatccatatcacaagaagtcaccccaagtgtcagtatagtcaatgctatcatagatattttcttcatattcaccattctttatgtttttagaaagttagttcgactccgaaagaatattgtttcgtattgggatagttacccaattggatattactgtctacttccgggtcatatcctttatatttagtcactgtgagtaaattacgtcctacaaagtagattctggcgttactgattactcctgttttctgaatcagtttggccggaagggtgtacccgacagtcaggtttttcatacgcataaatgaagcattttccagtaaatgcgtatcaaactgcatcggggagtcgggagtggcaattctggttatatctcccggcttctgccacatggtaagcatttctacagtttgattgtccgaacctgcaaaagtgggattctctgtaaaaaagcgctcattattcaacatatactggcctagcataaaagagaagtcggcactaacagaaatccctttccatccgaactgggtgccaaagccaccggaccatggtgcatagcgttgtttgccgacaaaaactgcatcttcttcggagtaactcttagtcagatttccatttttgtcgtaccacatattatatccgtcacgcggatcgactcctgcccatttcacatagtaatattctccccaaggtttgccgaccttcatttttaaaccagtatcgggtaaggtatattcatccaatccgttaaacagtttagttatttcattcttattataattcaggtttccggagacactccatgagaaatctctcgttttcagaatatccactcccagagtaatatcgaaaccacgattacgcatacttgctacattttccacactactaccatgtccggtagtgtatgacaatggataacccatcaacatatcgtccgtctgacggttataaaattccagttctacagaaaagcggtcaaacactcttgtactgatgcctacattcagtgttttcatgctttcccatgtcaggttatcatttccgacggtagaaggagcaatacccggttgtccgttatacagcaaaccggagccgaccaatgccaacgcattataggcgctgataccggaattaccagttgttccatagctcactttcaactgtaaactgttcaaccatgaaacgttctgcaggaaattctcttttttcatatcccacatggctcccaaagaataaaagtttgcccactggttgtttttggcaaacagagaagaaccgtcccgccgtgctgccaaatcgacataatagcgatcagcgaaactataactgattgtgccgaaataagaattgaaaaccttgtcatacatcgaatgtatcggcacttctgactctgctccagctgccatcagcatcattcgtgaatctaccatttttttagaagttgccgagaaattctcattctttgtgataatggactcctgaccggccaacacggtaaaaagatgcttgtctgacagactgaacttatattccgccgtattggtgaaagtaaatgaataataacgttcgaaagattcggacgccacccctgccccttcaaaggggccttccggataggctttatgggagttacgataatcaaaggcatctactgcctgcgaggtacgtatattcaatccttttattgggtttatattaaagaaggtattgccattgatacgtaccgtactccggtcattcggttgaagttctgccaagtaatacggattataatatcccatatcgtcaaaatagtccaatcgttttccatagcctgcaaagttgccttcttcgtctgtcaatatctcgtttattgtttggtcaggacgataaatacgggcagcatacgctttattataaacgctattagcttccgttccgaaagttgtcgtgttatatttctgataggaaaggttcacgttaatcccggctttcagccagtcggtcacctttacttccacattactgcgcaaagtctcacggcgcaatgaggaatcatccataatcccctctgtatcataatgtccaaatgaaatataatagttgataccttcggaaccaccgaccacatttacatcatattgttgtgtaggagctgcatctccgaagaagacatccgcccaatctgtagatataccattatctatatagaactttttccgtttttgaaatgtagtatcgtatgcttttcccgggtccagcatttcctgcaggttaagccattgttcggtattcatcatctctatgttatccccagtcattctcgaccagccatattgcgcattgatactaacacgggctttctgtcccatttttcctttcttgctagtcattattactaccccgttagcagcacgagaaccatatatagctgttgaggaagcatctttcaatacggtcatgctttcgatgtcgttcggatttaatgctgtaaatgctccggatgatataggtgaaccgtcgagaataaagagaggttctgtatttgaattgatcgagctgactccacgcaatcgcattacaacacttccacttggttctccactgggagtaaatacttgtaaaccggcaacttgtccttgtaatgcatctccggcattagcaaccggtctattggctatcttgctattatttaccgttgttaccgaaccgactactgaccctagtttctttgctgatccgtaacctaccacaacaacttcatccatcagttgtgtatcagactttaagataactctaacagtcggctgaacagaaaccgactccgttttcataccgatataagagatttgcaatatttttgctgaatttggcacattcaataatgtgaaatgcccgtctatgtctgttattgtacctaagttagtgccttttacaacaattgaagcccctacaacaggttgtttgtcatcatcggaaataactatccccgtgactttctgcgtttgagctgttatcagcccgatacctataaaaaggtatccaaatagcagcgctaattttttcggttcttcgtcaaatttggtggtaatctcttttttatttcgatggttttcctcttcttctttcttaatcctataaaaagttgtagatatgtttgctttttagtaactttaaagacaccacatcattaagtcgtttttacgtagggcgttgccctacgctatataattaagccctttcagggcactccgcaaaattatcatttacctcattcttgtatagcaacaatctttgaaaaagaatgggtaagataacgtccgttcgataaaaatcagcagatttgtcagcaatcaaacctaatatgtcagcaatctgaccatcgtttcagccggatattagcatctttgcaccaagctttacaagtataaagcacatattacgtttaacctttaaaatgctaaaacgatgaaaaaagtagcactattcctatttttatccgtttgcttcgcgcaacaatcctgttcgtcggattctgttggaacggaaccggaggaaaatccacaagacattctttttaaagacgatttcaactttttcgacgaaaaagtatggacgaaagaaactcatgaacccggttggaccaaccaagagctacaggcatacgatgccgctcatgtatcggttggaaaggacggggataaatcggttctgattcttaccgccgaacgcaaagggaataaaatttactccggcaggatcaattcaaaagggaaaaagagtttcaagtatcgcaagatagaagcaagtatcaagcttcccaagactaacggcggactgtggcctgcgttttggatgatgggagataacgacaaagaatggccggcatgcggggagatcgacattatggaaatgggagaacagagcggaatggctgcgggcgattcggaaaaacaagtgaacaccgccattcactatggccctagcgcagcggctcacgaacagcaatactacaaagccaatgttgccaacagcctgcaagacggcaattatcacacctactctctggattgggatgaaaacaacctgacaatatccatcgacaacgtcaagtttcatacgttcgacattagctcgaacacatacttccacgacaacttctacatcctgttcaacctcgccgtgggaggtgcgtttacagggattaccgacattaataaactgacgggcctgaaagacggtcagaaagtgaagatgtacatcgactgggtgaaaatattataggaatcttaaatatacatgctatgaatatggaaaaatgtaagtatctactgttttgcggaacactcgccctttggatggcgggaggtttccagcaagtgtatgcagcaacggaaccaagttcccaggctattcaacaacaaagtaacaaggtaaccggaaaagtgagcgatgccacaggtcccatcattggggcttccgtagtggagaaaggaactgccaacggaacgattaccgatctggatggaaatttcagtttgaatgtaaaagcgggagctacgctcgttgtcagctacgtgggttataaatccgaagaagtaaaagcgggaagaggtcctttgaacatcaccttgaaagaggatgccaaagcattagatgaagtggtagtcaccgcccttggcatcaagagagagcgcaaagcgttgggctacggcattgatgaagtgaaaggtgaagccttgaccaaagcgaaagagacgaatctcatcaactccatggcaggacgtgtgccgggcttggtagtcagccagaccgccggtggtccttccggttctacgcgcgttattctacgaggcagtaccgaaatgaccggcaataaccagcctctttatgtagtggacggtgtacctttggacaacactaatttcggcagtgccggcacaaacggaggcttcgacttgggcgacggtatttcgagcatcaatgccgatgacgtagaaaatatgtcggtattgaaaggccctgcggcgtccgcactttatggtagccgtgccagccacggtgttatcttgattacaaccaagcgagccaacaaggataaaatcagcgtggaatataacggaacactgactttcgatacccaacttgccaaatgggacgaagtgcaacagatatacggtatgggaagcaacggtacttatagctatgatgccatatccaacacaaacaaaagttggggtcccaaagcggacggttcaaacatgctgaagtatttcgacggcgtagaacgccctttcctcattgtccccgacaatacgtccaacttcttccgcacgggtatcaccgccaccaactccgccatcataggtgtgaacagcggaaaaaccggaattcgctttacctatacggatatgcgcaataaagacattgttccccagacgcacatgagccgtgacattttcaacctgcgcgccaatacgtctgcaggaaaggtagacctggatttcagcgtcaactatacacgggaagacgtgaagaaccgtccggctctgggcgacagcaagtccaatatcggtaaaaacctgatgacccttgccaccacctacgatcaggaatggttgcaaacctatcagactgccgacggcgaatattccaactggaacggcatggatccctacaacgtgaatccgtactgggatatctataagaacttcaataaatccaagaaagacttgttccgcatgaacggcaaggccgtatggaacatcgacccacatctgaaacttcaggcaacgctgggtgccgaactcaactggttcacgttcgatgattacaaagcacctaccactcccggattcgaagccggaagacttcaaaacagtgctttccgcaaccgcatgtacaactttgaagtgttggctctctacaacaaccattggggtgatttcgatttcaacgctacgctgggcggcaatgtatataaggtgaacaaccagaccaccgttaccaccgctcaagacatgaagatacgcgatgtcccttcattgacgagcttcaacgagatcagtgtagtgcccggcagttaccgcaagcagattaattcggtttacggagcagtgaacgtgggatggaaacacatgctttacctcgatgctacgttgcgtggcgaccaatcgtctacccttcccactggcaacaacatgtatatgtatccttctttctccggcagctttgtattctccgagctgacaaaactgggcgacctcctgccttacggaaaggtgcgtatgtcatgggcgcaagtaggtagcgataccgatccttaccaattgggactcgtctatacgaaatccaaatatgcttatcccggatataccatcggatatatcgataacggaaccatccccaacaaagacttgaaaccaaccaaaacaaactccgtggaaatgggattggaattgaaattcctgaagaaccgtatcggactggatttcacctactattctcaaatcagtaaaaaccagattatgggaatggcaagctcctggacaaccggttataactatcgcttgattaatgccggcaagatagaaaacaaaggtattgagattgcccttagcacacgaccgattcaaacacgcgatttttcctgggacattaatctgaacttctccaaaaacagcaacaaggtaaaagaactggatggcgaatcggatatgtttgaactggaaaaagcatcttggctcgacgttcaggtggccgctaaggtaggcgagaactttggttctattgtaggcccggacttccaacggaacgaaaagggagatattctgattgacccgcaaaccggtctgccgcaatatgacaagagcaaccacgtattgggtaatgcctcttgggactggacaggtggattgctcaccaactttacctacaagaatctttcgctggtagcggtattcgatgtgaaagtaggcgccgacctctattctatgtctgcccgtgctgcttacgaatcgggtaaaagtccggaaacattggcaggacgcgacgcctggtatcgctcggaagaagaaagattggcagccggcattgcgaaaggagccgataactggaagccgacaggcggattcgttgctccgggtgtcatcgacaacggtgatggaacatatcgtcccaacgacatctacatcaatccggaagactactggatgagcgtttgccgtaatgcaccttctatgtttatttacgacaactcatacgtgaaatgccgtgagctgacgttgagttataatgtacccaaatcctggctgaagaatgtagtaagcggactgaccgtttcgttcgttgcccgcaatccgttcatcgtatggaagaatatcccgaatatcgacccggattccaactacaacaataccaccggtatgggacttgaatacggttcgttgccttcacgcagaagctatggttttaatgtaaatgtgaaattctaaaaagatatatcatgagacaatctaaatacatcacaatcatcacgatggcatgtgccctgtttttcgcttcttgcagcgatgaatacatggaaaacatgaataccgacccttccaaggccgctaccatcgacccgaatgcgcagctcaccactgcccaactgcaaacgtacggagaccttagtatgatggaaatctaccgtaactaccattatgcattcacccaacaactgatgggatgttggaacaccaccaactacggcggacgccatacgctagacaataatgaaatgagccgtatctggacatcgttctacactcaatccctgaagaatatcattgatgctcaatatcgcacagccgaagatgcagagaaagtgaacatcaactctgtgctccgcatttatcgggtttatcttatgtctatcatcaccgacacttacggagacgctcctttcagtgaagccggcctgggattcctcgaaggaaagttcaatccgaagtatgacaaacaggaagatatttacaacgctttctttctggagctggaagatgccgtcaataaaatcgatccgaccaaagataaagtgacaggtgacctcatctatgccggtgatgtaactaaatggcaacaactggcaaactcgcttcgcctacgttttgccatgcgaatctccaatgtcaatcctacaaaggcacaaacggaatttgaaaacgctttggctgccaatgggggtgtgataacggacgcctcaagcgatgcgctcatcaagtacatgacaatcgcatttagtttcggacaagaagcttactctgattatcgcggaaattcattgtcgcagttattattcggcaacgaccccgctaataatccaagttacctctgctccactttctttaatcagctacgccaatccggtgaccctcgtacattcaaaatttcccgttgttattatgacgggctgatgagtgccaccagtcccgacaatcgtgtcgacatcacccaggagatgattgaaaaagggattgatttcagtccgcgcgacccgggtgcctactcgtgggaaccatggcctacaggatacgacagcgatatttgtaaggaattagccgttaacaatccttccgttacggtaactatggctcgtgaagtggaacccaaacttgccaataatttcctaaaaagcgacaatccgggcgtagtgatgacctctgcagaagtgaaattcctgatggcggaagctaccgtgaaaaaatggaatgtcggcagtgtgtcggcagaagatctttacaagcaaggagtgcgtgcagctatggatttcctgacagacaactacggttgcacggctactactgatgcagagtttgatgcattcattcaaggtagagggacgttcggacatacggacaatcagaaacttgaagctatcaatacacaggcctggattcttcacttcaccaatcctgccgaatgttgggcaaacgtgcgtcgttccggttatccgaagttgaaatcaccggcagaatatgggttcggacaatatctcaccggtggaacggaaattccggtacgtctctgctatcctgtattggaatcttcctataataaaaagagctacaacgaagccatcgagcgcatgggaggaacagacaattggcacagccttctgtggtgggatactgaaaactaactattaaacaatcatccattatgaaaaagatatatattgcactatttgccctactcgctgtaggctccacatttactgcatgcaccgaggaagaaccgttcgctacggtgacggaaaatgatgatccgcatatccttgccccggtattccctgacagaacgaacgggcaattggctacattcgccaacatcagccgggatgcgaacttatccatcgcgctgaccgtaactccgaaagattacaccacagtaacctggttcattgatggacaggaagtagaatcgggtaccgactccgacaaagaaatcaaccgtagtctgaaagccggtacgtataatttgaaaatagaagtggaaactgtgaaagggaagaagacttcccgtgaaggattggtggtggtcaatccattggctgatgaccctcaatctaaagaagtagcctttgagagaatcgtatctcccggtaagactgcccgtttatatggcagtaatttacagaacgtaacagccatcctcttgggaggaaacacaatcaccgatcctacttatgttgaatcggaagacgggaactatctggaatacatcgttccgacaggcgtaagcgaaggcgattaccgtatcgttctgcaagatgccgccggcaatgaatatggagccgacatggtgaaagtgaccaatgcttcccttgtcatttcgggggctaaccgggctactgccaacgtggactggaccatttccggtatcaatcttgaaaacatcgcttctctaactatcggcggacagacggtgtctcaattcagcaatcaatcttctacggaagttacgctgacttgtccggagttgtctgatggaagctatacgatgacaggcaaaactcgtagcggagaggctgtgcagttcttaaacgacaatgctacgactaccgaacagactgtgaccgtatctaccgaaataacgctttggtcaggacaccattacgtttcgtgggataagccggacggtgaccccaacaagagtttcggtctgattccaaaagatgtgtttgccggtatcacagccggatcaacactgaaagtagtctactccatagaacctactgccgaatatcataaaatgcagcttgccacaggctattggacaggcttggcgggtgagatggaatttacggaaaacggtgaatatacactgatactaacacaagacatgttgaataagattcaagctgaagccggattcttatgtgtaggacatggctattatgtagatttggtaaccgtgaaataatgttcctaagtcagtttaaaaatcattcataccataagtatctgtcattcttcgggttaaatccctctgaatgacagattacataaacgatgctacttaaaaacaaatcataatgaaagtaagaaatattatattaatgaccgcatctatcgcaatgactgcctgttccaaacaggcagttcccactgccattcctgaagacgcaaaaatagaacaacaagtggaagagcttctatcaaagatggaccttgacgccaagatagggcaaatgaccgagctcgctattgatgtattaggagagacgataaatggagaattccaattggacgaggcaaaactccacaaagcgattgctgaatacaaggtaggttcgtttctcaatgctcccggcccggtagcacaaagccctgaaaagtggaacgagattatcggtcgaatacaagaactgtcgatggcggagattggtattccatgtatctacggtctggatcagaatcatggtactacctatacattgggcggcacgctctttcctcaaaatatcaatatgggtgctgccttcaatccggatttgacctacgaagcggcacgtgtaacagcttacgaaacaagggctagtaattgtccctggacatactcccccaccgtcgatatggcacgtgatccccgttggccacgtgtatgggaaaattatggagaagactgtttagtcaatgccattatgggcagcactgctgtccgaggcttccaaggagatgatcctaaccatattcccaccgaccgaatcgctacctccgtgaaacattacatgggatacagcatgccacgtaccggtaaagaccgcacaccggcttatatatcggtttccgaactgcgtgagaaatgttttgcaccgttcaaggcttgtgtggaagctggtgcactgactataatggtcaacagtggttccatcaacggaaagcctgtgcacgccgaccgcgaactccttacacaatggctgaaagaagacttgggatgggacggaatgttaatcaccgactgggcggacatcaacaatctttatacccgcgaacatgtggcggcaaacaagaaagaagccatcgaaatggcaatcaatgcaggtatagacatggctatggaaccgtatgatctcaattattgtacactactaaaagagttagtgcaagagaagaaaatacccatgagccgcatcgacgatgccgtccgcagggtgcttagacttaaattccgtctgggtctgttcgatcatccgaacactttattgaaagattatcctctcttcggcagcaaggagcatgcacttatcgcacttcatgcagccgaagaatcggaagtattgctaaaaaataaagataatattcttccgcttcctcaagggaaaaagctactggtaaccggtccgaacgccaactctatgcgttgcttgaacggcggttggagctattcgtggcaaggacatctgaccgacagatttgccgacaaatataacaccatttacgaagcaatctgcaacaaattcggagccgatcatgtccgtctggaacagggcgtaacctacaaacccgaaggtgcttacatggaagaaaatgaaccggagattgagaaagctgtggccgccgcccgcaacgtggatattattatcgcctgcatcggtgaaaattcatattgcgaaacacccggtaatctttctgaacttgccatctctgccaaccaaagcaaactggtaaaggcacttgccgctacgggaaaaccgatcatcctgatactcaatgagggtcgtccccgcattatcaacgagttggagccattggctgatgctgttattgacattctattacccggaaactatggtggcgatgcattagcgaacattctggcaggagacgtgaaccccagtgccaagatgccttacacatatccgcgacacgaagcagcactgactacctacgattatcgggtgagtgaagagatggataaaatggaaggagcttatgactacaatgcagtagtctccgttcaatggcctttcggatacggattgagctacaccactttcgaatacagcaacttccaaacggacaaatcttcgtttaccgcaggagatgatttgcacttttccatagatgtaactaataccggtaaatatgccggaaaagaagttgtcatgctattcagcagtgatcttgtggcttcgcttactcccgaaaaccgccggttacgagccttcaaaaaggttgaactgcaaccgggcgaaacccagactgtcactctatccatcaaaggcagcgatttggcttttgtcaattccgacgggcaatgggtactggaacaaggagatttccgtatgcaatgcggaaatcaagtattgactattacttataagtaggtatttataagtaaatgtgcattattaatgtatacactcccgacaataactctatgagacactgcgttactttgtggtgaactcaaattatcatctaaccggttgaacagccgtttgagactgttcaaccaaatttaaacaaccgctcctcttgatccaaacgaccgtatgtctacaaaaaaaagacaatcgtttgagcccaaaggagcggttgtttttatctgaaggaaagcggcattattacaaaggatattcctcaaaagcatacaaaatggtagataaataacgttcacctgtatcgggtaataatgcaacaatcattttccctgcattttccggtcgcttcgccagttccgtagcagcatatacggctgcgcctgaagatatgcctaccaacaaaccttcctgtttggctaattcacgactcgtacgaatagcatcgtcattctgcacctgaataatctcatctacgatagaagccttgtacgttttaggaacaaaccctgcaccgattccctgaatcttatgcggacctggttttcctcccgagagtaccggagaatcaaaaggttctactgccacgatctttatactcggatcacgcatcttcagcgcttcccctacaccgctaactgtcccgccagtacctactccggccacaaagatatcgactttcccctcggtatctctccatatttccagaccagtagttcgtaaatgcatggcggggttagcaggattctcaaattgttgtaaaatgacagctcccggagtgacagccttcagttcttcagctttggcaatggctcctttcataccatctgcaccaggagtcaatactaattccgcccctaaagctttcagaagattacgtcgttcgatgctcatggtatcgggcatcgtcaaaatcagtttatagcctttagctgccgaaacaaaagccaaccccacaccggtattcccgctggtcggttcaatgatagttgctccgggatgcaaaattcctttcgtttctgcatcctcaatcatagccaatgctacacggtccttcacgcttcctgccggattgaaagattcaatctttacaatcagacgagctttcaggtcgttacttgtattatagttactaagttccaataacggagtattacccaccaaatccgtcaattttcttgctatcttttccatatatatctgttttaaatttctcttgttttaatatatgacaaagatagtgcggattctgttcagggtaaataccatatatgtggtaaattcataccacatatatctgacttcctgctagatattatattaagaaatcagctctcatagggctgaatgtatcaatcaatacacctgcttccagacaaacacatccatgaggctggtcaggttccacataataaccatcacctgtagaaagaatttctttccgatctccaatggtcaattcaaacttaccgcttgcaacataagtaacctggctatgataatgttggtgcatagaaccgacggcacctttctcaaattccactttcaccatcatcagttgcccgtcataccccattatctggcggcggattcccggagccggtttctcccaatccaattctttcccaaactgaaaagcatcactgcgtgttttcatcttccaatctattcttattataactatattatttgaatctcttcacataatctgcaatcagataacatgccgggccaagtacttgaccatgatcgaatccttgcatttcgtacaaagtcaccttctcgttacctatacttttcaagacagcttccaacaacgcattttcttcatatcttgccgccatctccagatgcttgtcccccgtaatcaacacgagaggagcagtttccttgcgggccttatttaccggagcatactcatcaaccaccggaataccgtcaggcaaacctcgttccttgcgaatagtgaaatgtgtcaccgtctgaccactcaccggaagataagcagctacactatcggcatttgctccgtatgctgccatgtactttttatccattgccagaatcaacgaaagatagcctcccgcagaatgaccggaaacaaaaatgtgatccttacgaccaccatacttcttaatattcttgaaaacccatgccacagcttcagccgcatcttcgatgtaagccggattctttgctttcggactcaaacggtaattcaccgccactactgcaaacccctgttctctcaattctttgggaataaatttatttccaccttccataccaccaccgtgaaaccaaacgatagttgagaaatccttcttgttttcaggataataaatatccagtttacaacgttccagacgataggtgtccgtttcggagccagagacataagatatatctttgtttgtgcgataagcattttgtgcttgagcaatgcaagcacaaagcaaaaagagaagaaggcaaatctttttcatgatcttatttatttcagtattttttagtattctttcccaataagcagcatacaaccaaatggcatccatgtttcttataaaatgcaatattacgaaattctaataagaaatagtccttctacatacagctaattctgttcatgcaaaaaattattcgtctgacgactgttgaactttcgtctaacaactgtcagacaaaaagtatacagttgtcagacgaataaagttattcagctagaaaactagtcttctgtatacataagactaattcttatataaaaagcgataacatcagcgtttatcatttcacattcattccttcagccattgtatacatatccggcaaatcggcagagaaaagcgaaaccggactttcatacatctttataaaactcttttcagaggcatgccctttaaaaacggagtagaaatgcgactcactttcactaggatcatatttgtttctccacatcacaatcatgctgacaaactgtcccgtagcaggggtaaggatttgctgtgtccaatagtttttctccggaacaccatcacgttgaataccctctactccggtttctgtaaccccacacggttttttcagttcttttgacagacgagacaaggtattcatattggtagtcagcacaaccggactcaaaccatgataagaatccattcctaaaaaatctacataatcattgccgggccatctaaataggaagttctcacgtccctgcacagaatctatttgcggggaaatcgcataaataaggttatgcacattttttgtgtcccgcaaataattgacggtaaacttccaaaaggaagtaaattcatcactggtcgtacatgaactcccccaccacgaccatgtttgggtatgctcatgataagggcggaaaatgaccggcactaattcaccattcttacctttcaaattcagtgcaaaattcgccaaacgatccagccaagttttaaatttaagatgtgtaggacttccctctttaagaatctccttcacaacctcattactggaattatcccatgaatcacctccggtcaacggattattcagatgtgcacatgcaataagtacctcgccacgctcataagcctctaaagcgactcttttacggatttcattttccgggttctgataacgatcatccattatttcagcaacatcaaaactgaaaaccgccggatagtcaccacaaacatcatgagtgtcggagcgtccttcctcattataccatttacgaccataccaaagatcatcatgatgtccgaacatgaaaccttttgactgaatagcccaaagattcgaatacaaggctttagtctcggaagtcgcatttttatctacaatggagagttctttcacttcttcatattccggataaagcgccgatacctcttccacatcgctacaactcataaagacggatgctaatccgaccaaaagtatattgatttgctttttcataattatctgtcttttaatctatattcgttaataaaataaaactttgagccttgaggatagtctgataagttccatcaacagttaatcctgtctggacagggacggggtgtccttcattgttagtttgcctattcccttcttcatatacatataaagaaacattctcgagagcagcaggcaaagaaatatccaaagatcgatcctcgtctcctatattaacggcagcaaaaacatattttccttgatattctccagcagccgcataaacacctttcgtgcgatcaagcgttgttttaaggatattagaaccagtcggaaaataacggcacatcaatgaccaagtgtaataccacggacggatttcttcctgcgaagggtcatcgaagacttcttctcctaagatattccacattccccacaacttaatatcttccgtcttaccagaatcaccgctactgtgcattgcgtcatccaacatccaggcagctattcccgaatatcctccattcattacctccatacagagcaatggcatatcaagaccataaaaatagtcgtataccaacatattagaatctgtacctttagtaaacggatgaccttcgacacgccggttatactctttcattaacaacgaatctgcttcacgccaatatttgtaaccggcctctcccaacacaatctttttaccagcaggaataaattccttatggcgagccagaatctccgcatattgcccagaacgtacttcatgttgtccgggataggcatgaatatcgtaaataccgatgtgcgaatccaagtcggtggccgcctgtttcacccatcctgccgcgtcaaatggagaagacggattcttgtaatcaacgactgcatcagggccggcaaacttcactttgccgtctagtccgggatattctttcatcttatccgcaaaacggagtaacatggatttccacaggtcgtagtcaccgtcagttgaagcccaattcccatcaggttcattaaagatcacaaaatatttgatacaggaaaagccaagatcattgaccagataattcaggtaatcgacagacatatccacccaacattgttcatccttcatagcccaagtagggggattatattcaccatacatcaccacaatattatgatccgtacaatactgcaacaagcgggaaagtgacgctatattacgtgttttatcatactttcccgtctgcggatcataataacgaaaaggactgttaatcatacaacgcacataccccatacgcataaagtcaaggcgtttaaacagtttctgccagtcttcgtcagaaacggaggctccccatgactcggcttcatcgtaagggtcccactccacaccatttcctatgtaaccggaagtaacaacctcttgaaatacattcactgtcagccggttgtcagagtgcgtacatgaaacaagcaacatccccaccacaaaagttcctattattgtttttaaattcatcattctgtttttaataatcgtaattagtatacactatcagtgattctgccggcatagtcactgtctctcctttctcaaggtgaagaatcaagttctcatcattcggcaaaaggagacaatctcctttctgtttcaacgtaccgtccgaatagatgaactttttacaacctgacagagaagaaagaacattactttttagttttaccgttttcggactatcagaaacattcaccaaagcaatcatatatttcccatcttttcctgatacggcagcctttacgaaaggctctccggtggtgtctgttctataaaccacagctccggcaggcatatacctggtcagtaacgaccaggcataataccacggacggacgttttcctcttctgctccgaaacattcttcaccgaatatattccagaatccccaaatcttcagtttgtcaggtgcttcattagagtgcatggcatcatccagcatccaggcaatggaacctgaaaaacctgtattgacagtttgaataagagcatctgccatatctgttccatacatataatcataaacaaacatctgcgaatcttccaacgaggcgttaactttactcctggctctacgaatattctccttctgatacaaagaatcagccttttccacaaatttaaaaccaatttctcccatcacgattttctttccttcaggaatcttctctttataggcagcaataatatctgcatattctccagaattaacggtgactttagacggataagtatggatatcgtaaagttctatttgttcgttcaactgcactgcacagctatctatccatcttgtctccgctttatcccagatggcaatatccggaccgacgataccaacttctccgatcaagtcaaattctttcatatattgataaaactgccggacagatgatgcccaaagaggaaaactcttattagtggcagcccaataaccattcggctcattcactagattgtaatagcggatacaagaatatcctttattatgaaccagataatcaaccaaggcagctgcgtgacgaagactttgactgtcaatctctgcttcgcgggcacgaatgacactccatccccaatctccgaacatgacagtcacattacgactctggcagtagtctaacattttggataatacttccatcccccgttccggcaccaatctcccctggtcaacaaacgaagaagtattaatcatgatacgaataaactgcggacgcataaaatcaagtctgtcatacagtttctcccaatcggcttccgaaatagttagtttacctttgccataatccagttgataaggatcccactgcgccccattgcctatatagcaatcatttagcaccgtttccgtatctatagtgattattacatcctgttctaccggagcacaggatgcaaaaaaggcaactataaaaagaaagaagtatttcttcatattttatcatccattagttaatcctcattttttgtcacgagtacaaagaacttacgtgcctgtttagcaaacacatcataatcagtataaatataggtccactcatccacaccattgatttggaaagagaaagcattattcggcaaagttaccgtattggtataacctcccccctggaataatgtataagttcccggattttcgagtacggcagtcgattcatttccgtccgaatcaataaaagtaatagtacctaaactgtaattacgaatccaacggctctctcctactgggattttccgataatacttcttcagatcaatatccgtcttatctgccggattagaagaacctttaaatataaaatctgcatatttcccatcaggcccagcagcatttatacatttcccggatgtgtttccatcatctgtgatattctccataataaaggtcagtgtattgtcatactctttttccggggaatattcatcataccagcaccatgatttgtccataaacggataaactcttccgccaccccattccggacctgtaccaccataaataatcaaattattaatcgaccatgtaccttccagactttcacggaattcattcacatagatcatatattcacgtgtttttccagttgcggaagttacagtaagaaccgattttcgctccggattactaaaatccaatgtactgcctttacctgcagaagctgtggcttgatacgacaattcgatagattctatttcaactttcgacaaatcaggaatagcccccacattaagggttacggtaacttccccggttgtatcatcaatgcgttcaatttcagcctgtcccacctggttcttgaatttaagattcgttacagacctctcgttattccatcctccatcattcaaatcatcctgcatgtctttcacacaagattgcattatccccatacaaaggataaacagtgtgtattttaatagtttattcatagctcacgattttttattattctcttaaacttggattaagattaatctcggtttgcggcaacggatagaaagaatattgactttcatttagtccggcatccttcacttctttgatttctccaatcctgccccaacgacgaatatcgtacatacgatctccttcaaaagccatttcaaacttacgttcttcatatactttctcccggaattcatctatcggcaatcctggagtcaaatcccccaatcctgccctatgccggataaagtttatcagttcataagccttggtagtcgggccggcagcttcggcatacaccatcgcaatgtcagtaaaacgaatgagaaaggggcgtgtactagtcttatccccatcaaatttgggatcgatgtattttcggcagaaggggtactcaaaatcaccgccatccggtttccattccgcttttaccgttccatcttcattatacaccttgtccacaatgagatctttcttacgcaaatcgtttccatcaaactcattatagaaattcatttccgtacgatattctccccaaccgtcatgagattttatatattcatctttgtctccttgcttgatccagatagtagcaccctcaatataaggaaggaacattttggatatcttagaatattgtccttctgcctctcccgttctatccatagacatcaagaaaatattttctttaccggcaaagttctctacatcataaatcttgagcaaatcactttcaaaaccatacgtattctgcggataatccggatccaatcctaatgctcttccggcataagtcatagcatcttgatagagagaattgacatctttcgccatttccttgtataaaggcacattatttgctttggcagaagctgcatataaatagattttagctaacaaagcctgtgcaccgactctatcgatacgtcccattatgggggcagcgtatacaggcaacaattcttccgcttttttacaatcgtcaatcatcaaatcataaatctcatccatattatttgccaaaggagtacccgtttgcgacagtgtctccactactccataatgcatcggtaccaaaccgaagttacgtgaaagacagaagtaattgtatgcacgtaaaaaataagcttcacccaaatactgatcctttagcttggaatcaatatccgtacccggcatcttcttaatgacagcattcgcccgattaatagcaatgaatgagtatttaaagaaattgaccaaagtagcattggtatcaaagttatcaattctccacagattcaaggcacgattatcaacggaggcatctcctttagtagtcataatttcagtaggcatatcaccgatgaaataaagagcacgcgaatactcgatataggtaagagtagcataagcgtaatgaatagctgccattgcatccccctctgttttatagaagttatcttcggaatagaatccgtaaggctcttcatcaagactgcaaccggaaaagcccaggatacagcttattaaaatgaaagtgtatatattctttttcatatcatttaatttagaatgttatatcaagacctactgtccatttcctcaagcgaggatacccaccagaataaattccgttttgcccgacttccggatcatacccgtcgaacttggtaaatgtatataaattggaagcattcatatataggcgtattttcgaggcaaacactttctgtttaggcaaatcaaaggtataccctactgtcagattctgaattctcacaaaagagccgtcttctatccaatagtcagaaaagcgagtctgacgtccgtcacgcagactgggatatttgttagtcgggttgtcaggtgtccaacggagtgcagcattatgcggatcaccaaaagtcttggtgttcaacacatcatttccaaacacaccattcaggaaaatactcgcatccagtttcttccaacggaaagaaagattcagacttgccgtaaaatcaggattaggatcaccgataatacatttatcgttttcattcacaacaccttgtgtcccgtccccatcatacgtattgacatatttgaattctcccggcatagcatcttctcccgacaatcctgcgttaagtccttccggcaaagtctgaataattccatcacatttatatccataaaagacattgatcggttggccaatagcaagtatattagtataagagcgatactgttcactcaagttaccgacaacttcatattccattcccgtacgggcatctttcaatagacccgattcgacactacttcccaaatcaaccaccttgttacggttcatagagaatataaaagttccattcaagctccaatcttttttatctaccataactccgtcaatcgttacttcaaatccccggttgcgaatcttaccatcattcacccacatgcggtcataaccggaagaaagagccaggtttctttctctcaacagatcagacgtctctttattgtaaatatccaaagtgacgcgaagtcttctgttaaagaaagccatatcaataccaaagtcccattgcgcagttgtctcccatttcagatccggattaggaattccactccaaattttccagattccgtcttgcccggactgccctgactcatacccgggaccgatagcagtcagccattgtccctgatggtaatatttagtcgttccataacggctaagagtctgataaggactgattccctgatttcccgaaataccgtaacttaaacgaaacttcaattcatcaaatgtatttagtttctttataaacttctcttcgtgagctttccagctgatagctccggaagggaaatacccccacttgttattcttaccgaatttagaagaaccgtcggcacgaaaagtggcagtaagcaaatacttattatcataagtgtaattcagacgggccattccggaaaccagtttacttttcgagaacccgttggaaataatattgttcgctttctctccggctcccatattctcatttcccaatgcttcattcacaaaaccattagcagtcagatacgaatcacgatattgataccactcgtaagaatgacctaccatggcgcccacttcatgtttgccgaacatttgagagtaattggcaaatgtttcggaaacaaaattttgattctctgtgttaccaatgactcccctaccacgattctccgtaccgacttgggtgtatttctgtggcagatactggtcgttggtagattttccatatttataattcaactggcttgtgagacgaagttgcggtatcacttgccattcaaaagccccggatgagataacatccagcattttggttttatcctttttatgctcgcgaatagcgataggatgactataatcttgagcagtagtctgataataagttccgtcttcattatacacaggataaatcggatttctccaataagccattccgccattgttattacggttgccaagatatagaatattggatgcacgaatcgtaaagttcttatatatcttatgactgacattcagattatacccccctttactataatcatcatcaatatacattccctggtccgtataataattagcactcaagttaaaactcgtcttctcgttagcactggagacagaaactgttgtattattagacacaggcgcatctctaaacactaattcatcccaacgggtattggttgtccaagtagtctgaagctcctcaatagacgggtaataaacaccggcagaattatttgcaccgatatagagcggctgtaatccaccattcacacgtccctcattgttcaacattgccatcatcaccgggtctctccacaaatccagtttggaagaaaattcggagaaagtgagctgctgtttgacagataccgtcgtagttccttctttcgcccttcgagtggttacaattataactccattagcacctctggaaccataaattgcagaagcagaagcatcttttaatacttccattgaaacaatatcatcggtattaatctgtttcaaatcaccggcatctcccaatggaaaaccatctaccacaatcaaaggtgaattggatccgcgcagcgaactattaccacgaatacgaaccgttgatccggctcccggatcctgtgacgaattgattacttgtacaccagccgcacgcccctgcaacaatccttcaacagaattagccggtatatcacttaatgcctccggctttaccgtcgcaaccgatcccgtcaaatcactctttttcaccgacccgtacccaatgaccaccacctgatcaagtaattgagtagcatcactaagtaccgcatttaccaccttttttccggaaaccgatatttctatactattcatacctacataagaaaactctaaaaccccattcaccggcacattggccagagagtaattcccatcaaaatcactgactgttcctacagccgaacctttaattttaatagtagctcctatcagaggctcaccttgtacatctttaaccactccagtcacagtaatcttggaagatgtttgctctaccgcagcccatgcggtagaaaatacggacaaaaaaaggcatatcaacacaactttgcacagtgacatgctaccaagccgttttttctgtttattcatcataatataaaatttaagcgttgaattctttactgataatttgataatacaaatatagactataacctttcattttcattcgcactatttactctattattatacttttttgaacgatttaatctatgattatctatttttcgcatagcaacctccccaatgtacacataaacagtgtatacacatcacattaaaagactaaaagataaaggagattcagttaattacaccttgcagtcggtcaacaagtaagagagcagttcatttacagagcaggtagccacgcagacatacttatccgcactaccataatacacaaagagcgtatcatccacaatcacatttcccgtagggaatacacaaccgttataatacccgtttatctcgaagtcctcttccggttcgagaattgattcatgcgttttggctagtattttcagagggttatccaagtcgagcaataaagcccccaccctataatacccttttccgccatgctccacaccatgatagagcatcaaccaacccttatccgttttcaggggaggagtacttccaccaatcttttcctcccaagtattttcacgtcctgtcagaagaagatggctttccttaccctcccaatctaataaatcatccgaaaactttatccagatagaagggtattctacaccaaatttttcgccaatatactgcttggggcgatgtaacataacaaattgtccgtttaccttctcgggaaaaagaatcacatcgcgatcatcaagcaccggtgaagtcagacgtcccaaacggcgaaaatggcaaaaatctgtagtaacagccagcccagtattacctaaattcttagcaatagctgcaggagcatacttaccacattcaggaagtaaaacttcatcatgcccaaacttccaatactgcccgggtggcaccggccgataggcataagtaatataatactcaccatcaaacttcacaatacgaggatcttccacacatccggaatcaggcccatcgacactcggagaaaaagccggccgatccgagtgcctttcaaaataaaacccatccctgctcgtagccaatcccaagcggataacatgttctctatcattacctgcagcacgatataacatataaaacatgccgttatcatagaacacgccaggattacaagtcaccaaagattcccaatcattcttttccgacggagaaagaatcgggtttccttcaaatttctttaatttcatatattctatttattttattgaaaaataatccaaatcaatgcgcttaacacaagtaacacccctgcccatacctgatagttcttataccagactactgttttcaaggttacatattcttctttcagatcgctaaaagaaaaggtggtgtcagtaagcttatctttacccggagccgcataaaagaaactgcttacataaatcaccattatactgaatatcaacaagaaaggaaccatcaataaaaagtgcaaatcaccaaaaaccgtatttttaaagaaaagtaaaagaaccgctactaccagaccgagaatcaatcccataaaagctccgtcaccattcactctcttattaaaaattccaagaaggaaagccgctacgataggaggagaaatataagaaagcatttcctgataatattttagaagagatccgaatttaccaatttgaggtgcccataatgcagctaacagaataatcacacaagaagcgattttaccaaccagtaccagcttttttgtatcagcatgtttattaaacttcgcataaaagtccatcgtaaacaaagtagaagtagaattcaagatagcactaatcgtagaagtcaatgcagacaacagagcagccagcataatacccagcaaacccacaggcattaattgcatcaccatattaggatataccatatcgggtttatccaaacctggaaataaatcacgggcaatcaatccgggaatagcaataatgaacaatgtgctcatcgtgagaaaaccggtgaatataacacctctccgaccttcatcaatagttctggcactcaaaacacgttgtactaaagtctgattattagcccagaagtaaatacccaatatgggcatccccacgatcagccccaaccaaggagtggcattatcggacaacgggcgaatcagcttcaccaatatatcatcgttttcaaacaaatgatagaaataacttcctccctgctgaaaacagaaataggtaagcaaaaccgaacccaaaatcaaaactaccgcctgtatcagttccgcgttaatggcagaagaaagtcctcccggaattgtatatgaagctgcaataatagcaaagactataataatcatctgaagatcagcttcaggtaataccagtttgataattaatgcggctgcataaagcgcaccggcagcatccagaaaaatatttccgataatacaaatagcggaaaagtagtaacgggaacgtttatcaaacctcttctccagaaactccggaatcgtaaaaaccttcgaccttatatataaaggtagaaggaaaacagcaaaaaacaccataactacaataccggtcaggttataattgaaaacggcaagccccgtatcataagcatcacccgattgcccgataagcgtagtactggatatactggcggcaaacagagacaaccctacaacccaccagggcatggaacgtccggcaagaaaatacgattgggcatccgaactctttccgttctttacaccccaccatataataaatagcaaatatacgactacgattacaatatcaatagttccgatagaaaatgattccatagcattcaattagttattaagtataattcactttgcaaatgtaaggcatataatgatagttttttgatattatattgcttaataattatacttttttgaatagcctgtttttgtattattattattcgtacatttgtatcaagttaaatacagttcttatgaaagacattcaaaaggaaattactcccatttcttctgatgatttattcatcgttttaaatcatcccaatgcaaaatttgattatccggtacattatcactccgactatgaaattaatcttgtgatgaatacgtatggagaaagaattgtaggcgattcagtcgaaaagtttgacaatctggatttggtaatgactggccccaatcttccgcatgcctggaaaggggagattgtagaaggcaatcatgtggtgacaattcagttctcggacaaattgctcaattttccaatattggagaaacgactattcagcccgattaaacaactgttactcgactcacagaaaggaattagcttttctgaaaacaccatgctggcaatgaaagagaaaattctccagcttacccggatgcaaggcttccacaccgttttagagtttctctctatcttgtatgatctctccactgccgacagacatattttagtcagtaatctctatgacacaaaagacacgatacgtacctcaaaaagtagacgcattgcaaaagtctgcgactatatagagaagaattttgaagaacctatcaaactgggagatgtagcagctctggtaaatatgtcggaatccgctttcagccatttcttcagaaagaaaacaaattgcacctttattgactatatcaacaacctccgtgtggcccgtgcttgccagatgctgactgaaacatcacacacagtagcagaaatctgctactcgtgcggatttaataatctatcgaactttattcggatattcaaaaagaagaaaggaaacacacctagcgaataccgtacaatcctgcaacagatgttgattaaatattaagtgcatttatttaatatccatcgaccaacgatttgatttttagctgtcgggaaaagtccgtatatgaaatatcggtacgaactttcactatcttatcttttcccggcatcaaatcgaaataattatcttcaaagaaattatcaattccatcaagagacaagtatacagctcttgcaaaacggtctgcttttaaagtcaattcatatccgtcaggcagtgactttaattgatatgatatattcacttgcggatataacatctccttttgcttcgtcaagaaataattatttgtgtaaatcgttccttgttgatcggtaagggttgcggagataacaagctgattttccggttgtgattttataaatgaattcaatttgtgggacataacgactttactttcattagcaggaatagttaccgatcttctgattgaattaacaagctttccttccatgtcacagacttccagttccagtatagcgctcgttttccttaatctatcagatacaatatatacatcaagcctgtcattattaactatgggagatacaagcacgtcccgaaaagctgccttagcaaaataatgttgcgctttccaacgtccgtagtaatcacggctcgaccacgaagcaaccggccagcaatcattatgttgccaaaataatgtccccatacagtaaggcatatccctgcgatgtgcttcaatagccgttttaatagcatccccttgcagtacaaggttcatatacagaaatgattcgaaatctttaggtttgcgatattcgttcagcaaatagtcttcaatcagtttgttcgcgaactcacctccccgttgatgagacatcattacctcggaagttatttcccagtcttcagggtgcggagcatacatttttaccgactcaaattcgggaaaagattgaaaaccatattcactaaagaaacgactacgcaccttattatattcggagatcggcttttttgcatgccatacagcccaataatgcgtatcccctttattattctcggaaactccgtcataacgactgaagggcgatgaaggccaataaaatgtttcagggctattttctgtcaccacttccggtagcattttatgaaacagatcttcatactgctgccagataatccgggcatactccggattctgcttcgcatagttttctttccaattccaaccaaaccaagcttccagacattcattattaccacaccataaagcaagagaagggtgattgcgcaaacggcgaacattatcaatcgcttcctgacgaatattttccagcaattcaccttcggagggatatacgctgcaggcaaacataaaatcctgccacacaagaataccatatttatcgcataattcgtagaaataatcatcttcataagtccctccaccccacacacgcaaagtattcatattagcattgacagcatccaggatcgttttctcatacagttccttcgtcacacgaggcagaaaattatcacaagggatataattagcccctttggaaaatacaggtattccattaagttgaaaatagaatgatcttccctctttatcctccttacgtataacttttaatgaacgtattcctgtagaagttataagacaatccttattttgctcgtttgtttttacttcggtccggaattcatatagattggcttttccgagtccattgctccaccacaaattaggattctttataaagaagtttacagcaatcttattcaatccttttgtcaggcaggtagtagtagcaccataaatctttccagtcttattgtctctgaccgtaacttcagccttctcaatatctttatcggctagtatttctacaatattactaatgtcggcttgtttataagaaacctctttttgccggataaacacattttctatccgcaaatcatcccatgcttctaataaaacaggtctccagataccagaagttaccaggcgaggtccccagtcccaaccataatgatagcctgccttacgggcaaaaacactaacctttctattgaatactcctccattctccgactggtcgttgattgcctcatagtgaaaaggcagcgcatcccatttaggcatatcccgtttaataggagaatggaaatatatccttaatttattatcctttgctttcagtttatcttttacgggaagtttccattcacgaaacatattgtctgcctccaatatcttttctccattcaaatagacatctgcataagtatcaagccctttaaaataaagccgtatattgtttttatccatcaattcgggtgctacatcgaaggttgtttcataaatccagtcttccttatcaacccactgtacacctctttcatttaagcgataaaaaggatcttcaatgattttattatcaatcaagtcagtgtgtactactcccggaactgtagcaggataccagttagaaagacgagcttgtttaaacctccatcccgaatggagttctttctgaagtgtattggcagatatgttaccattcagagtggaaaatgtagtgaccatagctagtgcaaccatctttaaataaattatccttgttgattttctcataacaactttattgtgtattagatttccatttaaaataacgttgcaaacataggcaattgtcaatcaatattttaatactatattacttaatcattatactttcttgaaaagggtaataggaatttattttatttaaataaacaactgcttatcgacttgataatatatactttcaatgttctatttttaatattatacaaggaaatggccaattagaaaataacgaaccggaaaataaactgcataaataaacgcatgagcatacaaaaggatgcctaatattgcataaaagcaaacaggatatgcatctttctctattcagaaaccgctcattgctttaaaaccaacgaagtgttcctcggtgtgcatcgacttgttcctcaccgaggaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaccaacgaagtgttcctcggtgtgcatcgacttgttcctcaccgaggaagctatcgttccccggtgaagaagataaaaatggactattaagaaacatttttatctctagtttaccataatatatcggaaaggaaaaaataataaaatgattagttattcgggcatctgctctccaaataacaaaaataatcaaaaatctatcgcagcttgattggcatattttcgaaacagccgaaatagagaatcgcgtaattacaaatgcaggacattttcctgcttttctttaccaaactgcaattcacgtccttcttccaatgattaaatattccttttttaagaatcatcgttttttaagaggctactgattccttcagaaggctctttcaacttttatccttcaatagctcttttgtcttatccgccaaaaacagggggatattaatcaaattaccatcttgtttcaaattcagcattgaatagcgaatcaggtaagcgggttggaaaagcttctcataatgaatcacacttttgatatcagaaatgtgataacttacacatttctgatatgagtttcgtgcgaatctacacattatccatataaaacgaaagaaaaactctgaatattagcttgccaacagctccctgtttatttaaaagtaatcatcaactgttcatcaacacctttatcaggtattctcacactacagacacctgtttccttatcccaactccacgctacagtttcagtgttattctccagattttcttccaaacgttccggtttagtttgctttatcttctttcctttgacagttatctctttcggagctttcgcagaataaatacggaacaacagatttctcggaccgggaacagtgtatccttttccttcacgggcagagacggtcagttcatatccatttgccagagtgctgcaaataatcggtgttttgacaaattcatcacgctgatatcctaagtcttctccttcatcttcgtaaagagtaaaggctgcttgtgcaccttcctgggcgggaaagatttcaaaagtaagtggatataccggtttctcatgggtgtagttcatcaccggcatggtggggatgatggaaccttgcttcacaaacatgggaatagaagacaagggagcgtcaacggtagtccattgctctccggtgtagaccgtctgcttgttgttgtagtctatccatgtgccttcgggaagatacacgttctttgtgcgagcacctttcttcaccacaggagctaccaacaattcacgaccgaacaggaattgggcatccgtggagaaagtttccatatccattggatattccagaaacagaggccgcatgataggcaatcctgtatcatacgcttctcgggcgtaagtgtagatatacggcaacaaacgatatttcagctcgatagccgctttcgcgttcttttccgcttccggcccgaaaagccacggttccaccgggttatctccctcatggtggatacgactcaaaggattaaatgctccgaattgaatccaacgggtatagagttccgccatagccggataatcctcaatatccccacagtaaccggtgatatcacaggaagaaaatgggattaatcccaatccggcggaaagcattacaggaatctgattggctaattgtccccaaccttgcagtacgtcgtctccgtttccgctatcacccgtccagccaaacgtataacgttgcaagccggcataagcagcacgagtcatctggaaaacacgacggtccggattcctcttttcaaattgctccttcaccactttgtcccaggtcagaccatagacgttatggatttcatcgtgcataccgagatggtgcttcatcaccaggcgctccgtctgctcttcgttactccaggcaggttcgcccatgtctgtccagaagccggagacaccatcgtcaataggtttctgctgataagttccccaccagtcggctacggcaggcaaggtaaagtccaccactccgcagtttccaccccacggccagggcatatcgtagcttttaccgttcgtattgtcctttacaaaatagcccagacggtctgcttcttcccattgttttttgttggcttgtgcaattaccgggtcttgagatacgactaccttaaaacccatctctttcaaatccgaaagcatctttttggggttttcatagtttcctttgcgccattcgaaatcctgcaaatattctgtccagccgatatcctgatagataatatcacaaggtattccccgtttccggtagccttcggctatctcacgacttagcttttcacttgtcaacagaccgcggcattgagcaaaacccaacgcccatttcggcggcatgataggttttccagtcagtccgacgtattggctgatgatttctttatagtctttaccgaagataaagtaatataccatttccccgttcggagcttcaaagctgtaataatcacggctctctgttccgaatttgaattccgtcttataggtgttatcaaggaaaataccataccggtaattgctcataaagaaaggaatactcttgtaaagaggatcttctaccacactataacaaggtttgtcactattccacatcttataagactcgccacgacgatccatctttcccgctttctcaccaagtccgaagaagtgctcgtcacgacgaagcactttatattccactttcttcgttccttcactgacatggcctttatcggcataatcactaaacagaagtttctgatatttatcgaatatctgaagactcatcggagatttattcacccggatacgcaacttcggagtaaatatctcgtaacaggccgcctgttcatccacatgaatagttcctacctcttccagttcttcattaatcactgcaaacgaagcatttcttcgttgcaattgcccgtcgggtgagaaccagattttcacgacggaagagctgcaaagttgcaattgcaaggcggcactgtccgtcaggtgaaaagtcacctgacgtccttgttgtgtaaaagaagtgcacgtacgtatctcattttccgcccaaacccatgttggaaacatcagacacaacacccacacccataatctatatctaatcatcatacctatcattttagttattctgtagcagccactttattcagccacaatcatcgtccaatatttcagggaaggcaatgtgaaagagacaactccattctcctgtgtaaaggccaattcctgcaaagcccctccgtgtacatccggcgacgctacccacagcttattcacctttgccgacagattcatttgcaaagccgcttttgtaatcaaagccggttccggcatcgtaccgtccacatctctccagctaaggctgttcgcttgcgagaaattaagaagatgtatcacttgcttgccacctacctgcttggcataagtagtaaccgatccctgttgaggaggccaactattcaatctcatttcgccattggtacaattcatggaaacactattctctgtaccaccgtcacgaagcaggttttgataagaagtcaggaaatcataataacgaaccatcgctgttttcaattcttcgctcattgtcaggttctcattcggaaagtactctttgcacaacatgtgatcgcctcccaactcaaggtgcgaaccacccaaagcaaacatgacagcatccgtcagcagaatacccggcgtattaaattctccccggttatccgctttattataattcatataagctgcaaaaaccgtattcaactgataattgccatagactccattttcataaagaatggctttcagattggtaaaatcagcctcatccgcccacacctcattatagaagaaatcaactttacctgtctcccctatctgacgggcaccgtaacggctgaccgcattcatcaccaaactcttgtccggatgagcctgcttcgtcgcttcaataaaagaagcatatccctcacgcagattgaccggaataccgttgtaattgtaaagcgtgctgcgtcgtcccaactggtctatctgatagccgtcgaaggcaaagttcgcatatacatcatcattcctttcgttcaaatatttctgccattccttattagaaggatctaccagataaatattacttttccatccgcccggcagatcatgactgtctttagtagtgtgagaagcatccttaaacaaataccattcctccttcaccccgtccgcagcggcatccttcaacgccccaaaacaaagattgtaaaacatagacttcataccgaaacgatgctgcgcttcaatgtaattcttcacagaacttgtataaacctcccggttagcgatgtccatatatacttcgtccaactgcgtacgtgtaccgcccaacggccagtgatgtttattatgccagtcctgaaactgtacccaattgatgtgatgacgattcagatacgccatctcttcctgtgtcttttcggctgtcttctcccgactgaaatcagcgacaaaaccataacgcggaaaacgtgccggatcactggatacatctaccgcaatcgtaccgacaattacatccgtaccattctcctgacgatacagttccgccatatatcctttgaaatcagtagtaggcggttgccatatccagctcgtaccatttaccgactcttctccgacaacctcccctaaaagacgatagcgaactttagttccggcaggcaacgcatcttctgctgtaaataccactttctcccccggtttatagaaagccttatccgtagataggtccacacttaaatccgatgttaccggagtcacttcggtaacactgcccgaagctcctccattctcctgattcgacccatgatcgtcactgcaagccatacacagaaaagcagccacccaatatattattttcttcatcttgaattcttgttttattgtttcacaatcgaaatcgtctctttcaactggtcaatcgtaatccgataagaaccggcttcctgaatattccatttataatccaaactacccaaatctgtatccggatacatactgttcaactccgcatccgacttagcaacgaacaatgccgtctctacttcccccgtcggagccttgttgctcttatccgccataaaccaatccccgttccagtctgactgcttatcgcaggatatcttcatctcacctgccttcagcgtgccgctccaggtaaagatataaggactgtcggcactcttagtcatcggagtagcattgcctaaatcccatccgttcggagttgcctcacccaccagatacagtccttcgtaaggagtgaacggacgcatcagcatcttttcttttccttttcctgtgtagaaccatactttataaggcttgccacattcggcttccttcatctgccatttattatcgtcacctccaagcactacggatgtcgaagtgtacggagcattagccatggtaggatggaagaaagcatccgcctgaccgaaatctgtcacagaagcgaatttaaattctccgtctgccttccagggaatcacggctccataatggaacagatccatttggacagcatctttagacagtgcttcaaatccccaaccattgttacccgtaaacgaaccgacaatgaaaaattcttcatatctccagccaatatcttctgtttcggtaagtgtcaacgtcaagtcgagcaggtttgcttttacgatataagttgcttctttactgattgtgaactgttcgtccggttggtcacccgatgtacggtaggtcagtttgaatccttcttcggcagtagcatcgcggttgtacgacggcaggaattctcctaaggtcgttataaacttaaacgatccggtattcagctttcctgtccatgtaaattgtccgttatccgtacgttccattgccgttgcgttatcggcgctccattcgctcggagcagcatcaccaatcaggtaaagcgtggtagtaaccggctggtaggtagtcactgtaaaggcagtcgtcgcaatctgtttctgatcttccattccggcaacaaccgctgtgatacgtgcttccaactccgctttcacggcatagccgataccgaactgcgtattcaagaattggttgagttcttccactttcttagtccattgatacgttcccgtacccaaatctaccgaataaggattcgcaaagtccgttccggctttcgccagttccagcgtataagagatacggttaccgcttccataattcgtaccggtagtccatgaaagcgccaatgcttcctggctatggttcttttcgttcaacaccaactcctgctgattcaccgaaagggtgagggtatcatgtcctttatctgtctccatataatcctcggcacaggcaaccatcgttgcaccgatgaaaagagagcataacaactgatatatatatttcttcatcatattatttgtctaaatgaatgattataaaacggattaataaccgggattttgagtcatcaggtgattggagtccatctccgtctgcggaataggcaacaggagacgttctttggtcacattattcttaccgatagatttcaggaatgtcaatgcataatttccattatcaacccggatcatatcgaaccagcgatgtccctcaaaagcaagttccatccgacgttcatgaataatcttttctctcatttcggtctgcgtcagagtggtcggcagctctgtcagcccggcacgcttacgaacgatattcatcggttcggcagcctgatccggatgtccctgctcattcaaggcttccgctttcttcagtaagacatccgcataacggtatactacaaagttgttggggttggtattatactccggagagacggttttcgatacaaggaacttacgtacgttataacccgtattcgaccaggaacgtctgtattccataccgtcaaaagcaggacaaccctgatacaacacagtgatgtctttccgcaaatcaccgtcttcgtattgcttgacaaactcttccgtaggcaggttccatccataagcaccggctaccatacccgaattacgtggtcccatgaaagtagacaaccaggacgcttgattatcgccgccccaaaagtcatattccgtactaccggagtattgcacttcgaagagagattccgcaccattattgatcgtcgcattaaagttatcggcataattgcattgagtcagatcatatcccattgcagcaatgttattgcacaaggtcactacttcattataatagtcacgatgattgggagccagtgtcaggtaaatatccgccagcatcgccattgcagcctctttgcaggcacgtcccctgtcagcatctccataactgcttttcggaggaagcatattcactgcatttttgcagtcggaaagaatttgagcatatacctcatctaccgtattacgggcaatatccgcagattctcccggttcaaacggctccaagcgtaaaggcacccctccgtacaaacgaaccagaatataataataatgtgcacgcaggaaataagcctcacccatgcaacgggtctttatctcattggagacagatgctgaaggcaaattggaaagcacgatgttgcaacgtccgatcccaacccacggagaacgccatacatacaaggcaaagccgttatcgctctgggcaatgaaattggaagcctgaacagtctccaaaccgtcagtacctcctccggctcctacttcactgttgcctgcaatgatgtcgaggctccaaatacgctggttatacatattagatgactgaagagtcttgtagcaggcagtagtcagtgccacagcaatctcattcgtcacttccgattcgggatcgacgccatatttaggatatttatccaagaaatcgttgcacgatgtcaatgccagcatggcagacataaataccaaagttattatctttttcatattctttctcctgatttaaaagttaaagttcaagcccatactgaaagtacgtgaaatcgggtaacggctgctgtcgatgccattaatatccacttccgggtcgaagccggaatatccggtgatagttgccacattctcgcaagagaaagagatgcgggcattttccagttgaatcttttgcatccactttttaggcagtgtatacgaaagcgtgatgttcttcagacggagataggaaccgttttccacaaacctgtcggatacacggcagttctggttcgggtctccccaaatggcgcggggcatagagttgctggtaccttcacccgtccagcggttcaatacggctgtggtttggttgtaagcggctgccattccttcgttgtcaacattgttggcgttataaatcttgtttcccgatacgccttgcaggaaaacggagagttcccatcccttataagagaaattattgcttaaagagaagaaccagttcggattcgggttaccgataacggtacggtcttcatcgttgatgactccatcgttattcaaatcccggaaacggatatcccccggagctgctcccggttgggtggcgtggcggtttacttcctcccagttttggaaaagtccgtcggtcacgtatccgtagaatacattgatcggataaccggctctaagcatagtcacgtatgagttacccatctgattgataaacatcggagtttcgctgttcagatccagaatttcattcttgttataggtagccgttaaagcagattcccaagagaaaagacctttcaggttgatggtgcgcagggtcatttccactcctttattacgcatcttgccggcattggtaaaggtttcagtagtatcttcaaaaccggaggtgatagggatggaagctttcaccaacatgtctgccgtctttttgatgtaggcatccaacgaaaggttgacacgtgaattgaacagactcatatccacaccgaagttggtttggcgtacctcttcccaatgaatattcggattggaaagggtggtagataccaaagcggtggagttgttgttgccgaaaggataaactcccgtattataggaagccacaaagccgtagttaccgatttcctgattaccggtcacaccgtatccgatacgcagtttgaggtcattcaccggagagttgtctttcgggaaccattcttcctgcgaaatacgccatgccagagaaacggaagggaatgttccccaacggttgttcttaccaaagcgggaagaaccgtcacggcgcacagtggctgtaagcaggtatttatcttcgtaagaatagttgagacgtgccatcagagagagcagtgcccagtcgctctggctgccaccgatgctgtacatcttctcgccgttgtccatctcatggatattatcaaacatgaagatattcttttgagcattcaggtaatcatagttgttccactgggcggaagaacctgccatcacccctacacgatgtttttgggcgaaagtatggtcgaatacaaaataattatcccacaggtaggtaaatgatttgttgtcactcttatagcgggaagattcttctaccggattcggtttccagtcgtaagccggagtaaagttgtctacaaaccagaatttggcgtcataaccgaaggtgcttttcaacttcaaccatttggtaaaggcaatctctccggtgatatttgccagaaagttatatcctttcgtctcgttcgtcatcatgtacaacgtaccgatcggattgcggacacttccataccattgcgcttcctgtccgggaccgctccagctaccgtcttcattcttcaccggctgggtggggagtgctttcatcgcatctccgatgctatagcttcctccttctttcacgtccgtactgaatgtcaggttagtagtgaacttcaaccatttattgacctgggcatcactatttgcctgaaagttgaaacgacggtaattaacgctttccacgataccggactgatcgaggaaaccgccggatacatagtaatgtgccttttccgtaccaccggaatagctaaccgaatagctttgtttcactcccgtacgtaacatctcatccagccagttcgttcctgttcccaataaagaaggatctgcccaataagggtttgtattatcatcattattagacagcatatcattgctcaaagcggcatattgcgcagcattcagcatatcgggcactttagtagcgttctgaatagcccagtttgcgtttaccgttacttttccggcaccttcggcaccacgtttgctggtaatcatcaccacaccgttggcaccacgcgaaccatagatagctgttgccgaagcatctttcaatacgtctacccgttccacatcagccatattcaaggaagacaatcccaagtcggtaggaattccgtcaatgacaatcagcgggttactgttattgatcgtacccaaaccacggattttaatggtgacattatcacccggcttaccggcatcgataatctgcacgccggatacttttccctgcattgcctgaccgatattagctaccggagagtctttgatgtccttcactccgacagaagatacggcaccagtcaaatcgctctttttcatcgttccgtaacctactacaacaacttcgtccaatacttccgtatcttcctgcaaggttactttcaacgagtttttcccgttcaccggaacagtctgcgttttatagccgacaaaagagatagtcagcgtgctgttagccggaacgcttaatgagaaattaccgtctacatcggttatcgtaccattcgttgtacgtccttccaccacactggcaccgatcaccggttcacctgtggcatctactacatgtccttttattgaaatctgttgtgcgaatgcactaagagataggaacaagccccacattattaataagaggcggcgttcaaagcctttcgacttcatactctgtttcatgtacattaatttaaagttaatattagggttacttttgttttcgttctctgtgtcattgctgaaatgaccgtgaaacaaaagtatccacatttcatactgcttctttgagcagatagcaaaaatatagtgatttacacagtatctcacagcataaaccactaaatataagaacgttataaaatagaagtcagactaaaaaagtagtggttttcttattcttccaccttccctatttgcattactttagtctcaaattcatctctttctcccaaagctttgttacggacacgggtccggtaattataaatggtagtcacggaataacggaggaattgcgctatcttggtactgtccgtaatccccagccggataagggcaaagatacggagttcggtgttcaacagttctcccggtttgggttgcatgggttctgtgagcagcgcattaaattcctccacaaaattggggaagagttgcaggaaagtcatgtcgaaatttgcataaaactctttcagttcttcgtcaagaaattgagaagatttaatggctttatatagttcttccactcttccggcagcagcaattttatttagggaacgacggtataaatccatcttgtcgagataagtggagcattggtccatatatcggccgatatattcctccttgatatagttggcttccgaaagcgtatggttcatctctttcagttgcgaattggagtcgtgaagttcttcgttcagttcttgcaacaacgtattggtatcgaccacttcgcgacgtgcggcagcaacctttttcatctgtttgtaaacgaagaaaatggcaaccaacaaaaatacggaaagcaaactgatacaaatcaatgatactttcatctcctgttgctgccgtttggttttcaattggtaagcctggtcaatgataggaaagacttgcgagatttctaacgtacgaaggcgggcattacaaagagtggcatcctctaaggagcatttcaggtaattgtaggcacggtcaatatccccttcatcgtagacaagggaagcgagtttgcgcaaagatacatattcctttactgccgatttcaggtcggcaatagccgaaagggccaggtaatgtttttgcccctgcttgtcgcctttcaaccggtaaccctcggagagagtataagtaagcattgcttttgaatggtcatccaaagaaggtttgttgtaatattccatcagcatacggatggcttcatcgtattgagcatgtacgatacacttatccgccatcaccaatacgtgccccaaagagtcggaagcgttgacctgcagaagagagtcacgatacagatccgtcattcgataatactctttcttgactttctccgtaacggcataatctcccatcaatccgtaaatagtgcgatacagatgataatagtaaccatagagataatcgggcaacgttttcttatcaatctgccccaatagttccaacgcttctttatacattccggtagttcccatcacttccgccatattcatggcagcatcatccagataatccagtttatccatgcgatgcgccagttcctctt
